United States Patent 6,979,557 (FULL-LENGTH CDNA) - sequence listing, part 2

SEQ ID NO: 993 - DNA, 2978 bp, Homo sapiens
gacatactcacatcgcctgggatcgagacttcagccggcagaggcatacgcagaagctgtacaaaggctactctatgtacccccgacatggacctacgagtgcgacgaggacctgatccacttcttgtatgaccacctgggcaaggaggatgagaacctgggtagcgtgaagcagtatgtggagagcatagacgtttcctcctacacggaggagttcaacgtgtcctgcctgacagacagcaatgccgatacctactgggagagcgatgggtcccagtgccaacactgggtacggcttactatgaagaagggcaccattgtcaagaagctgctactcacagtggataccacagatgacaactttatgccaaagcgggtggtggtctatgggggtgaaggggacaacctgaagaagctgagtgacgtgagcattgacgagaccctcatcggggatgtctgtgtcctggaggacatgaccgtccacctcccgatcatcgagatccgcatcgtggagtgccgagatgatgggattgatgttcgtctccgaggggtcaagatcaagtcatctagacagcgggaactagggttgaatgcagacctgttccagccaactagtctggtgcgatatccacgcctagaaggcaccgaccctgaagtactgtaccgcagagctgtcctcctgcagagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggacatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgttttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccaccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttagggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcatgcataccggaaagttgaataaatggatgaattc

SEQ ID NO: 994 - DNA, 2310 bp, Homo sapiens
gcagaagtgccgagtcccggccgggggcagcctcgccgccgctcagctcgggaatccctgccccccaccagcacctcagtgggggatactgcaagttcaagcaccagcctcacagtaacagccggcacacagcacttaggctgcctggtgttccagaagcttctgcaggggccctatgctgcactcaaggcatccctaagaggagagcattttgctgtccccactttacggagaaggaacgtgggctcagggtggtttaaggtgtgaatgaatgaaggagcaagcagtaagccccgacagcaaggccaccacagccctcgccccacagggacgcctgagcaaggacccaagcaggggacaagcaggctcaccccgcccttgcggggctgaccacgaggccccgtccggtggaacacgccatgacgcttcaggaggctcatgtagctggcgccgtatgggacagcgggggagagagaaaatgcacagcccagggaatgtggagacaggcccagcgccaggcatgggggccggaaggagcagccggggagcagggggcagggcctggagtcccgccttgcagatctgaacctgccccagccccaggactctgagtgcagcaagaggggagccgggctggagagtggggagcacggagactgtggcctggatggtgccagagcaaacaggagagaggctgccccacgcagaggctgcagcacagaccagagggtcccggggctgactgggtgggggcagctcccagcgagaggcccctgggatttgggtaagtagaggcacatgcagactctggccacagggcacctcgcgcacgaggggagttcaccacacaagctgagcggagggcggacgcaggagagcagcggtttctcggaagccaagggcggtcatggagccccacgccacagcgcttcccacggggccacaccatccggtctgcggagggggctgcattgccgggaaggaccatctgattctggattccagcctcaccctgggccaccgctgagtgtcccaagtggccccttagcccccagggccaggcggcatcccaatcccctagggatgtctgtgctcagaatgtggcacacacgccccggcagggccatcctcctcctcctgcacccgccacagccgtgggttcggggtctctatcgtgggcagaaattcacacagttaaggtgagggtcccaggagcagctgtgaccaggccccggctgccagggagagggggtcttcagccgacggggcagacaccctgaggtggacccttgtccaggggagggccctgccacccacaattccttggcattcctgcaccagcaggacgggctgagggaggcgcctcgccagtgccagcgcccagcatcactgtgccccggtggagggggaggcccttccgagcctgggcctgggtgtggatgagggcaggtctctcacctctctgacctcagcttcctcaactgggaaggggggccacagcacccccttaggggtgatgaggaagtgggagctcagggaggaccccgggcagggctgcctcctcacctctcttcggcctttggacactggagctcagaggaccaagtgaatgaatgaatgactcgatcaatcaactgatccatgaatccatggacccctgaacagctggagagctgggctgtgggcaggacaggggactctggctgaagccgcgttcatatgtgttcagctttaggcctccactgtgcccggaccagcggcccactcagtgagtcgagtgtgcacctggcacccctctttctggaaatccacgaacaatgggctcccagcagaggactgaggctgagcaggccacttccctggagctgaccccacagctgtcctgctcctccttcgccttctgccatgactgtaagctttctgagggctgaccagaagcccagcagatgccagcaccatgcttcctatacagcctgcagaaccgtgagccagctaaacctctcctcataaatcaccgagccccaggtttatctttacagcaatgcaagacctgactaatacagcaccagctccccaaaataaaaagaaatattcaaacaaataagcgcacagaagtgttcccagcagcactattcacagcagccaaaaggcggaggagccacaggcttgtcagctgatgacagataaagaaagcatggcctgtcatcccagcactttgggaggccgaggtgggtggatcacctgaggttgggagttcaagaccagcctggccaacatggtgaaacccagtctctactaaaaaaaaaaaag

SEQ ID NO: 995 - DNA, 2864 bp, Homo sapiens
ggtcgctggcgcctgtttcctcagagccactttttcctttgtgttgtctggtcgttcactactttgagggaaaagaattttgccgttcgcgttcgattgactccgtccccaagatcctgtagccccacggacctggcgactccaccgtgttcgggtctttctaggaacccaatctgccttcatgaagaaaagacagaggcagaaaggaagatggcttactgcctgacaaattgttatcagtactccgtgacctttgaggatacagctgtggacttcacccaggaggagtggattttactggacccagttcagagaaacttatacagagatgtgatgctggagaattatgagaacgtggccaaagtaggatttcagctctttaaacccagtgtcatctcttggttggaagaagaagagttgagaaccttgcagcaaggagttctccaagactgggcaataaaacatcaaaccagtgtttcagcactgcagcaggagttttggaaaatacaaacttctaatgggatacaaatggacctggtaacctttgacagtgtggctgtggagttcacccaggaagagtggactttactggacccagctcagagaaacctgtacagtgatgtgatgctggagaactacaagaacctgtcctcagtaggttaccagctcttcaaacccagtctgatctcttggctggaggaagaggaagagttgagcacactgccaagagttctccaagaatggaaaatgtgcctgaaaaccaaagggccagccctttggcaagataatttttgtttaaaaacattaaatgggatacagttggcaagaaaccaaaatggagaggaactctatgactgtaagcaatgtgaagatgtcttctgtaaacatccatgccttaagaccaacatgagtactcaaaatagaggcaacacgtctgaatgtattcagtatgcaaaagacctcctttctctatacaataaaacctctaccataaggaaagtttctgtgttcagtaagcatggaaaatctttccgcctgattttaaatgttcaggtccagagaaagtgtacacaagataaatcctttgaaggcactgactatgggaaagccttcatttatcagtcataccttgaagcacacaggaaaactcagagtggagaaaaactcaatgaatggaagcaatgtggggaagcatttactcactccacaagccatgctgtaaatgttgaaacacacattattaaaaacccctatgaatgtaaggaatgtggaaaagattttagataccctacccaccttaataatcacatgcaaacccacattgggataaaaccttataaatgtaagcactgtggcaaaaccttcactgtgccgtcaggctttcttgaacatgtacgaactcacactggagagaagccctatgggtgtaaggaatgtggtaaagcctttggtacatctgcaggccttattgaacatataagatgtcacgccagagagaaaacctttaaatgtgaccactgtgggaaagcctttatttcttacccatctctttttggacatttgagagttcataatggagagaagccatatgagcataaggaatatgggaaggcctttggtacatcctcaggtattattgaagatagaagaagtaacacaggacagaaacgctttgattgtgaccagtgtgggaaagtctttgtttctttctcatctctttttgctcatttgagaactcacactggtgagaagccctttaagtgttacaaatgtgggaaaccatttacctcttctgcctgtcttcgtattcacatgcgaactcacacagaagagagactctatcaatgtaagaaatgtggtaaagctttcactaagtgctcatatcttaccaaacatttacgaacacacgctggagagaaaccctatgaatgtatgaaatgtgggaaagccttcactgagcgctcataccttactaaacatttacgaagacacagtggagagaagccatatgaatgtaagaaatgtggaaaagccttcacagaacgctcagatcttactaaacatttacgaagacacactggagataagccctatgaatataaggactgtgggaaagcctttgttgtctcctccagtctagttgatcatttaagaactcacactggatataaaccctataaatgtaatgcatgtgaaaaggcttacagtaggtcttgtgtactaactcaacacttaaaaactcatgcagcagagaagacctctgaatgtaacgcatgtggaaattcctttcgaaattccatgtgctttcatgatcgcttaaaaactctcaccaaaataaaaccctataaatgtaaggactgtgggaaagccttcacttgtcattcagatcttactaatcatgtgcgaattcacactggagagaagccctataaatgtaaggaatgtgggaaggccttccgtacatcctcaggacgtattcaacatttaagaactcatatgggagagaaaccctttgaatgtgaccagtgtgggaaagcctttgcttctttctcagctcgtattgcacatttgaaaacacactagagagaagccctgtggatgtgaagaatgtggaaaaacctttgctgtttcctcaagcctaactgaacatgtaaaaattcacaggagaaagtaacactatcaatgtaaggaatgtgagaaagcctgaacagttgaatctttctagatatgtacaaactcacactgtagagaaaccctgtaaatgtaagggatgtaggaaaacactagttcttctctctctcttttttttttttgatgagtctcgctctgcactccagcctggcgactgagtgagactccatctc

SEQ ID NO: 996 - DNA, 2724 bp, Homo sapiens
catatattcccagggatgaaaaaggaaaccttccttgtgaagacctcagaggacatatggtgggcaagccagtgcataagggatctgaatcaccaaattcatttctggatcaggaatatcgaaagagatttaatattgtcgaagaagatactgtcttatattgctatgaatatgaaaaaggaagatcaagtagtcaaggaagacgagaaagcaccccaacttatgaaaactctctacttcggtatatgagcaatgaaaagattgctcaagaagaatacatgtttcagagaaacagcaaaaaggacacagggaagaagtcaaaaaagaagggtgataagagtaatagcccaactcactattcattgctacctagtttacaaatggatgcactgagacaagacatcatgggcactcctgtgccagagaccacactataccatacatttcagcagtcctcactgcagcacaaatcaaagaagaaaaacaaaggtcctatagcaggcaagagcaaaagacgaatttcttgcaaagatcttggccgtggtgactgtgagggctggctttggaaaaagaaagatgcgaagagttacttttcacagaaatggaaaaaatattggtttgtcctaaaggatgcatccctttattggtatattaatgaggaggatgaaaaagcagaaggattcattagcctgcctgaatttaaaattgatagagccagtgaatgccgcaaaaaatatgcattcaaagcctgtcatcctaaaatcaaaagcttttattttgctgctgaacatcttgatgatatgaacaggtggcttaacagaattaatatgctgactgcaggatatgcagaaagagagaggattaagcaggaacaagattactggagtgagagtgacaaggaagaagcagatactccatcaacaccaaaacaagatagccctccacccccatatgatacatacccacgacctccctcgatgagttgcgccagtccttatgtggaagcaaaacatagccgactttcctccacggagacttctcagtctcagtcttctcatgaggagtttcgccaggaagtaactgggagcagtgcagtgtctcccattcgcaagacagccagtcagcgccgctcctggcaggatttaattgagacgccactgacaagttcaggcttacactatcttcagactctgcccctggaggattctgtcttctctgactccgcggccatctccccagagcacaggcggcagtctaccctgccaactcagaaatgccacctgcaggatcactatgggccataccccttagctgagagtgagaggatgcaagtgctaaatggaaatgggggcaagcctcgaagttttactctgcctcgagatagcgggttcaaccattgctgtctgaatgctccagttagtgcctgtgacccacaggatgacgtgcaacccccagaggtggaggaagaggaggaggaggaggaggaggaaggggaggcagcaggggaaaacataggagaaaaaagctaatacactgcgagagttggtagaacctctccatgccaaatcggatccacttctgttggcactcaacccattggactcacagattgataagctaatgtttagagaatttagatcggagagagtcggtacggcgcagactcaacatcaacctcttgcaagcaactaaaatggcctcgtccttgctgtttataacagaaaacagacttgtaaaaagcttagatcatcaagtgttttggattgggggcctcccaaagggatataagaggggcaggccactcttaagaagaatgcgagctttctacattgggactagcataagatcaaagccaatcaagatggagcacagtaacagaaaactgcggtttctgtgggagaacagaaggggaaagggtcttaactgggaaagggctctgtgtggtaacacctcagttgcgttctcctgacaccaggaaaagagagggatcagcttcaataactagaaaattctggctgtttaatggactctttggtggcctctttaaggcaaagcagagaaagcaaattatgtattaagtgtattttgcatttttaaaacttgacgtgctgtattgtactaaattaagtgtaatctattaaggcaaggtatacacaatttgctttgaaacttactatgtttattctattataaagtgtattcaggtgcaacacagagactgctttcggtgacattaatgaagaaaatttctcatgccaggctttattatagaatcttcagctaaaatcctaactttctccttatttcttggcacttgtatacaagtggtgttgcctcttagggcaggcatgagctattcttttctgtaaaatattttgaatctataggctgtgggtttcatttttgaaaagtattttgtctggatgtctttcaaactagcttcagatattatttaatactatgtaactgggtcccctatggctcaatcaatattgcttatttttcttctgtagtggatgtgaaatttcctttagttggataagatacactgtaataattttaatgctaattaatgatatttcatactgtgcaatgaacagataatttaacactgtattttgaaatgtttttttcttcctgtcaccgcggtgtgtggtattgcataatgtgaatacctgtaaaaatataaattacttaaaaataaaaatatgaccaattggtatc

SEQ ID NO: 997 - DNA, 3684 bp, Homo sapiens
aaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcccggggctgcgcgccaggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggagcatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtggttgaggccgtgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcggcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaagggcttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtgaggcccagccctgcccataatgggcactggcgctggcaccccggcccttctgcatttcctcccggagtcactggtttctcggcccaaaccatgctccccagcagtggcaatggcgagcaccctgcagctgggcgggcaggcggcaggcgcggaactgaccctctcgcgggactgaccctgttgtgggcagtggtctccccccttggcgcctccttgcgcaggcccagcctccactctcctcgtctaggtttctttacctccagggatcagctgtgtgtgtgtgacctccctaccgggctatcggcctcttgggagccagcggcagggccggcacctgcgtgcctgtgcccgtgtgcgtgagacagagcccttgcccctgctgctgccccgagggctgccctgccctggaagggcccctctgcctccacaccagtggagtcttcgagacttgggagctgcttggcctcattttcagccatgagcagacggcctgtggtccctgggcctgaggcacggactcgtagcaccagggtttggaggctgcgaccgccccggagagcagcttcacactggcgccacagaggagccccacgtgcactccccggcctgcatccggcttgggtacacaggcccagaggactggggtgactcacgggccctgtgctgtgatgttgagagctgagaaaaacctccaaggccctgagccccatgcccagccctgccttggtcccccaacccccagagcttggagtctgggccccacacccagccctgccttggtccctgagcctcagagcgtggaattgctgccctgtggacactggctgggaaggcaggtcttcccctagcacatggggaccccggcctcgagggtgacctccctaccttgcccctgccagccaccaagcgcaggtgcagcgggggccagactcctgccggcctcagaggacacctggcccagcacaggcagctagaagggccggtgggcaccggggccgggaagcccccacctcaccacctgagggcccctgggaggctcctctggcctggctgggctgggtctggggccgccacaggcccctcacggggcggcagaggcaacttcagtgtccctgttagagcaacacgggtccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctc

SEQ ID NO: 998 - DNA, 4208 bp, Homo sapiens
agtttccggtagacccggaagccgattgcagggagaaactgttttcgcagcagtgcgcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggattcacttccaaagagacatattatgcaaggaagcaacttggaagaggaaagaaaagaagtcaggaatggcccttactcagagtctcacacgttgcccaggctggagtgcagtggcatgatccctgctcattgcaacctccgcctccctgattcaaaggatttttccacctcagcttctcatgtagctgagattacagggacccttgaaattcatggatgtggccatagagttctctcaggaagagtggaaatgcctggaccctgcgcagaggactttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggcagggagtgcatcaaaggtgtgaacacagttcctctactccagcagaaccttctttgttcacgtcctcaaagtcctatgttcggaggccacttgtccgacatcctcggagtccctcttctgggtcaccagttgccacctgcacagaccttgggggactgaacaaagggggcgaacattggaataaaagacaaagagaggagctctaaattgggaagtaatgcaggaaacaagccttgtaaaaatcaacttggattcacttttcagttacatctgagtgatctacagctatttcaagctgaaaggaaaatttctgggtgtaagcattttgaaaaacccgtcagtgacaattcctcagtttcaccgcttgaaaaaatttcttccagtgtcaaatcccaccttttaaataaatatagaaataattttgatcatgctccattacttccacaagaacagaaagcacacattagggaaaaagcttataaatgtaatgagcacggccaagtctttagagcatctgcaagccttactaaccaagtaatccataacgcagataatccttacaaatgcagtgaatgtggcaaggtctttagttgcagttcaaagcttgtgatacatcgaagaatgcatactggagagaagccttacaaatgtcatgaatgtggcaagctcttcagtagcaattcaaacctttcacaacatcaaagaattcatactggagagaagccttacaaatgtcatgaatgtgacaaggtctttcgaagcagttcaaagcttgcacaacatcaaagaattcatactggagagaagccttacaaatgtcatgaatgtgacaaggtcttcaatcaaattgcacaccttgtacgacatcaaaaaattcatactggagagaaaccttacagttgtaataaatgtggcaaggtctttagtcgccattcatatctagcagaacatcaaacggttcatactggtgagaaaccttacaaatgtgaagaatgtggcaaagcattttcagtgcgttccagcctcataacccatcagttaattcacactggaaggaaaccttacaaatgtaaagaatgtgacaaggtctttgggcgcaagtgtttcctgacctctcatcagagaattcatactagagagagaccttatggatgcagtcagtgtggcaagatctttagtcagaaatcagaccttatacgacatcgaaaaactcatactgatgagaagccttacaaatgtaataaatgtggcacagcgtttagagagttttcagaccttactgcccattttctaatccatagtggagagaaaccttatgaatgtaaagaatgtggcaaagtcttcaggtacaagtcttctctaaccagtcatcatagaattcatactggagagaagccttacaaatgtaacagatgtggcaaggtcttcagtcgcagttcaaacctggtatgccatcagaaaattcatacaggagaaaagccttacaaatgtaatcaatgtggcaaggtctttaatcaagcatcataccttacaagacatcaaataattcatactggagagaggccttacagatgtagtaaatgtggcaaagcatttcgagggtgttcaggccttactgcccatcttgcaatccatactgaaaagaaatctcatgagtgtaaagaatgtggcaagatcttcactcagaagtcttccctcaccaatcaccatagaattcacattggagagaaaccttacaaatgcaccctgtgcagtaaggtcttcagtcacaattctgaccttgcacagcatcagagagttcattcatgagagtccctacaaactgtgtatggcaaaaccatcatcatgagttctagcattaatcaacatcagtgagtccatactaagtggaaatcatataaatgaaatgtatgtgacacaggctttatcaaggcctgccaaatcactggacatcaccacatcactgtggaggatgaaagcacacagatgaattgtgtgtacttgggctattattcaaggaccattgctatagaacacgataggatttacacaagaagtaactctgtctctggttctctgatactaatctatgatattgcatgatgcagaataatgctaagtcaaaatatgttgaatctcatgacctgatgtatatcaaaggtgcaacggcttgtaaatgaccagttttattcaggctataaagcattcaattatttggggcttatagaaaaggctactttactctttgtgacttcgaaatcttttcatgtgccttccatacaggccattcactgtggtccctgggaaagaatcagtaggatgacagggctgacttcattagctgaggattatttctatccaatttcctgatgaaggacattgccttttgagattaaatattgtctgatttagagagcatggaggtgggcagagtaacataaaactgatgaccgtcatcatactgttgcagttagcacactttctcctgacataagtgcacagagcttcagtgtccaccaactgaccatgaaatagagtatgctgtaatcttaaggcataggttattagtgggaagagagtaataggttgctagtgtctgattatatggtagaaataatgcaaggaaaaaggtagccaccttctccattgaacagcagtacctgctgtttagcaaagactgatgagaagtagacttttttttttggagatagagtctcactcggttgcccaggctggagtgtagtggtgtgttcttggctcactgcaccctccgcctcctgggctcaagcagtccttctgccttagcctcctaagtagctgagactacagacgtgcgccaccacacccagttcatttttgtatttttagcgaggcagtgtttaccatgttggccaggcaggtctccaactcctgacctcaagtgatatgttcacctcagcctcccaaagtgctgggattacaggcatgaaccatggtgcccagcctcatttttgaaatggaatagagaacagttatatcacagttgagagtttaatcaaaatgaccggatcagcatattctttttttagatgagacagagtttcgcccttgtcacccaggctgtagtgcggtggcgcgatctcggctcactgcaacctccgcctcccgggttcaagcaatgctcctgcctcagcctcccaagtagctgggattacaggcgtgtaccaccatacccagctaatttttgtatttttagtagagatggggtttcaccacgttggccacactggtctcaaactcctgacctcaggcgatccatctgcctcagcctgaaagtgctaggattacaggcgtgagccaccacacctggccagctcagcatattcttaagtaggattcacatttaattcttggtattataagttgcaaccatttgatttagaatgtatgcagctctcatgtttgtagtaataaagtttcatttttcctaagt

SEQ ID NO: 999 - DNA, 2693 bp, Homo sapiens
taaatctcaacatccacatgaacttcacccatatctgcagaagccacaattctatcaaccagtccttggatgagtctgtgatttatggaccaggaaacctgtcaaccaacaacaatactctcagagaccacttcaaagggatttcttcccatagcagaagctcactcatgcccctgagaaatgatgtggataagagaggggagacgacctcagcatccttgctaaatgctggattaagccacactgaataccagatagtcacagaccctggggacgtcccagcttttttgaaatggctgtccttagccagcttgcttgtttatgttgctgctttttcaattggtctaggaccaatgccctggctggtgctcagcgagatctttcctggtgggatcagaggacgagccatggctttaacttctagcatgaactggggcatcaatctcctcatctcgctgacatttttgactgtaactgatcttattggcctgccatgggtgtgctttatatatacaatcatgagtctagcatccctgctttttgttgttatgtttatacctgagacaaagggatgctctttggaacaaatatcaatggagctagcaaaagtgaactatgtgaaaaacaacatttgttttatgagtcatcaccaagaagaattagtgccaaaacagcctcaaaaaagaaaaccccaggagcagctcttggagtgtaacaagctgtgtggtaggggccaatccaggcagctttctccagagacctaatggcctcaacaccttctgaacgtggatagtgccagaacacttaggagggtgtctttggaccaatgcatagttgcgactcctgtgctctcttttcagtgtcatggaactggttttgaagagacactctgaaatgataaagacagcctttaatccccctcctccccagaaggaacctcaaaaggtagatgaggtacaaggtcctaagtgatctctttttctgagcaggatatcaggttaaaaaaaaaaagttactggctggtttaatactttctaccttcttcacagagcagcctttgaatagactatgtcctagtgaagacatcaacctccgccttaagctatgtatgtatggaggccagtcgcagctttattatgcagacacacaagtggtctggacatgagggtacagtttctgcctaccaagacactacttgcactggatcttacgcaaaaaagaaccagaacacacagtgtggacaactgcccatatattctatctagattaggagagggtcctggctaggattttagtggtaattcctagttacattcaacaagtataaagattatagagcttattttatgaactataaactataatttaatgcaaaatatccttttatgaatttcatgttaatattgtgaaatattaaaataattccgcaatagttgagaaaaatgagcatttttttccatttttaaaaaatgcatagaaaagacaattttaaaatcctgggaccatatttatttagaagtagctgttagtaaaacattagaaaaggagtcaggccattaggttatttatccaaatctctaagcaattaggttgaagttattaagtcaagcctagaaaagctgcctccttgtaaggctttcatgacaatgtatagtaatccacagtgtccaattcttcacactcctcaggaatatcactacctcaggttacggtacacaggctataattgatgatgatgttcagataactgaagacacaataaatgacattcagacatcaggacaattccctcatgttcttttctatgatggccacctgcaccagcaacgtgggtttcacccacacaacgatgaactgttctcttacttctccagttgattttaaagacttgttaagaggtcttactaataaaatttgggtatgatagaaaatccacaatcaaatcttgaaccaaataacatattaaattactaatatttaagtgatggaagacacacaaaaaacttaaaagcacgaacaacctaacttgaaaaagaattttaaaatatgattaacctgaagaaaagagaatcctaagagccaaagctcctttttatttagcttggaattttcctattggttcctaacaaactgtcccaatgtcatataaggaaacatgatctattacattcctttataacaacgtggagagactataaacctatgtaagtagtaaaactatatcagagactcaggagactgactaaaaggcctggatctgcagtgtattatctgtataaaaattggcagggggaagctaaaaggaaaggagattggagatctcaatcctatcatggtgtatttcatacgcaaatcagagcatgcattgttttttgtttttggaaagagaagggaagtgtgttctgccccatgtttccttccgtgtttatagttcaaactctatatatacttcaggtattttttgtttagcccttcattataaatgggcaggaaattgtttatcaacctagccagtttattactagtgaccttgacttcagtatcttgagcattcttttatatttttcttttattatcctgagtctgtaactaaacaattttgtcttcaaatttttatccaatatccattgcaccacaccaaatcaagcttcttgattttcaaaaataaaaagggggaaatacttacaacttgt

SEQ ID NO: 1000 - DNA, 3834 bp, Homo sapiens
acttcgcgaagtggcacttcggggcgggcggcccgccgggtcgcggcctggcgctgcggggcggggagcggctcggacgcaggacgccgcgggccgggcttacaggtgggagaggccccgaccccgccgcttcgcaggccagcttcctgctgtgttccctgcacccaccgatctcacacgcagccctaggacagacgtccactggcctgagttgggtctggggccaacacggagcaggtgggggtagagcagctctgctctcctggaggaaagttgaatggctggaaccaagatgacagatggaggctggcaggcaaacacgggaggcctcctcactccaagaggggagtcagcctggggacagttcttctccaggccctgctgctcccatcagctgcaacacaggagaggtaggcttctccggaaaagctcccacggtcctggatcccgctccaccttctagaagctcccagcgttacttcctgagctggcctgcacatcgttgcgctactcccgtccaaggggggacatattcggtgaccgactcagaacgcagcctgcttcccgggtggccagtggctcagcagtctcggtgcctgagcctgctccctccgcccggcggctgggcaggtggctgaatgcgggctggaggccttccctgagaagacggttatccatgctgtacatggaagtgaccagctcggcacctgaggagacacaccgcggccgatgacaggcgcagagcaggacgtggtgaggtcctcatacctaggaatgcagaacaagggcaagaaactcggtgcccgcctggcatctgccctgcaccagtggcctccaggaagttctccaccaaggatgttccccaggcactctgtgctcgccttcaccagcgtcctgtgaggtctttcacactgatggggaagcctttctaaagggtattagggggctggggggctgggggtgctgagtaccaagggtcccaggaagagacaggccaggcttatgggctgggcatccagagatcgccctgacgccagctccaggtggagttaggagggcactcttgtcccgacgcatttacagaccactccctcttcttgttcccctcgactctgagagtgtggtggggtagctgtggaacctgactgcttgcctgaaggttgggcagcgtggttagaaattgcggcccagacctgggatctcacccacacctctatgagacgtcctgaaggaaaccatcggctgagcggagaggcttcgccttgcccgcctcctcccaggaaggaagagcggaagaggcgtcgccagccaccgagactgccagccaccaccccctcccagactctctgtccccaccccagaccagggtcaccttcttcctgcactgggggtggggtgcggtaggtttcgcaatccagactgtggggtgggggtgggagcaggtgtgtgtaaatgagcagctcgtcaggagtcactgagaaagaggcagatggagctggtacccagcaggtctcctctcataagcgtcaaccctcgcctgggcgggctgggggatcctcagcaccccagcactgagccaggggtctgcaacccgggcaccagcgatgggccctcatgcacacagggcgccgagcggggccggaggcaagagtgacttcagacaggaacccgacgccacagccggtgacgcggaccctgggtcagccagcacgatgggccgctggggagaggagggctggaggcagagggtgtaagtgtgcagccttcatcagcttatttttagtcgcgttatgtaagtggcttcatctcaacgtcacatgggggggggtctcagatttaattacaggatgacagcctttgcttttcaagcaagctgttctcctggcaagccaggcgaaggattggggagttttgctaaacagaaggagccctttctgaggtgaccacccgtcaaaacttgaacccgcttccacctccgtctccctcttcccgaccagcctcacccagcctcggctgaatgtggcctgagagtagccacttgtccgcaatcacagggacgttttatgcctgtcaagggagcttcctctctcctcttcctccccctcccaccttctgcctggcagctttgccttctctccaagagaagggtccacccaatcagaactcctcttccttttcattcctggattaaagcacttgtaatcagtaaccagaaagttccagagcgggagagaccggaaggcactggagtgctatcggacgggtgtctggggcagagccaggagggcgagcctcttctctccccgcctgcccttgctcacttccccctccatgccaggtgctgtgggagcagctgggcctggccggggtcggcgggtgaagctatccgcatggtgtctggagcaccgtttctttgcttcctggatgggctggatgggctcccgtgttcttcaccaatggcagcgttaccagcaccaatggcagcgttaccagcaagaaggcaaaggcaggagcacatcgagggtgggagccagggctgtggggtcaggagtcccgctccttgccgcgggaagcctggctcagccacctccagcacacttcggctttgtccagcataaaaggcagagcgacgttttcactgcaggctgtttcccaccagggcaagtgggacagggcgagtgctgacgtctgcaggcatggtgtgcatttaggggtgggcggcaccgagggggcatcatttggcataggcgggcccgggggccactgggctagatgactggctggttgctgggggcaggtgtcacagcctctctgagcaccctctaagtggaggacagaacattgttgggaggagtccaggcataaagtgacataaacagcgcagagaatgggaccagcgcacctgagaggtgatcattagcctcagcaactggatgggacattccgaagagctcccagccaacacagatggtcactccagaggctgacatttaaaaggaaggggcccggccgggcacagtggctcacgcctgtaatcacaacactttgggaggctgaggcgggcagatcaactggggtcaggagttcaaaaccagcctggccaacatggtgaaaccgcatctctgctgaaaatacaaaaaattagccaggcatggtggtgggcacctgtaatcccagctactcaggaggctgaggtaggaggatcgcttgaacccaggaagtagaggttgcagtgagccgagattgtgccattgcactccagcctgggcgacaagcgaaacttcgtctcaaaataaataaaagtaatgggcacagggagggggccccagctcgtgccccttctgtgtgggctgcacgtggtgacttccttccagagagcacagagtgggaggtaggcaaggcgtctccacagtggagagcccgacccactgtctcagcccagaggtcaaggctggcaccatcaccgagaggtcacacgggcagatgtgacagggcgcttcaccactgggctcttcctcccagacccataacccttgtcttagtattagaaaaacgctggcagaccgggcgcagtggcttacacctgtaatcgcagcattttgggaggccgaggtgggaagattgttcaagagcagtctgggcaacatagtgagaccccatctctacaaaaaaaaatttttttttaattagctaggcgtgatggcacatgcctgtggtcctagccactagaggctgaggtgggaggatcactggagcccaggaggtcaaggctgcagtgagctgtgatcacaccactgcactccagccttggcgacaaaccaagaccctgtctcg

SEQ ID NO: 1001 - DNA, 2884 bp, Homo sapiens
gcagatgtacaccgcgtcgtcgtcggccgagacattgcgcacggtcaggcggcgctcggtgccctcctcctcgatgccgtacttggcgctcgcccacaaccgcgtctcctccttgaaccacgcggcctcagtggacggctggggcacctcacataggaacgtggccgactccttctcccgcacctccagatcttgcagccgctttttgaagggaaccgcgggctctgccaggagagaagactggaacggacacctgcaaccctggattccacgaccggacagacgcgggtgggaaacggcagaccgcaagggcgaaaggacccaggtgcacgggttgcggaggagcctgggcccgcgcgccccgcacccaggagctcaccgcgcactacgaccagcacagagctgtaggtctggcccacgaggttggacgccgtgcaggtgtagaggccgcggtccgactgcttgcagaagaggatcttgagcacgaagttctcctgcgcgtcctcgtacaccacgtggcgccggccctcggtcaccagctggccgtccttcttccacaccgtctcgggcttgggctcgccggtcacgtagcagctgaggcgcgcgtgcttgccttcagtcaccgtgcaggtgcctgctgtcccagctactcaagagactgaagcaggaggatggcttgagcccaggaggtcaaagctgcagtgagctgcttcgccccatccctgatccagtgccaggcctctatgtgtcctcacagcgtacctcaggctcttccgggcaatggccaacatctctcatgtgtcctcaatcagaaggagggtgaggggtctctggagtaacggttatgccattctgcagccttatctcatgactgatcacttccaaaagctcacgttctaatcctgtcaccttgggggtgagcatttcaacgtgtgaatctccgggacacacattcagtccacagcaccagggagaaaggaaaggctggaaggagagcccactcccccaccaggagcttggccctgagctgccccagccatgcagaagtgtgtgtgcattgtgtgtgctcgaatacgtgccccaccccctcccggacagggccgtggagggtgcagagaagatggctgtgctggccagccccttgcagggcctcctggacctgggagaagcaatgcccccacagcctccaggagtggcctgccctcctgaccctcttcactgctgcctgctccgctgcatctccaaacaccactgccagccttcaggctggattttctgcctccttcacaggacccctgttgttccttatttccctgcaacgtatttgttgaagacagtgggatattcacactacagagcttccggaggcactgtgcccagggtgtccttcacaccacgggaggccacaggatgcagtggctggccatggaccttgcctattcctggctggaatccactgcaaagagaactttcatggagctgctgtctgttcaaaggggtacaggtggaggaggagcagacacaatttcctgaggaaagcaaatgtcactgtgtcccttgagttgccagcttccacagggatgtcccgccatgagccctcctcccaggggctttcacagctgggtgggctggcatcctgggtgcagtttaactgaagggggtgttctcacagccatctcccaaggcctgggggatggtgggcccggaggcctcagacctgcacctgctgcccaggcgatggggtggctgggccccgggtgcccacaaactataggcaaaaaaaactgtaagtcagtcctgcagggtttcctgaacattttatgatccccaagtcgtatctgaacatgtcaagaatctctggtgtcttggcttgggtgtaaagatgaagttctttcctcctctgtattccaggaggaaagagggttttcattcccttctgaatgttaggagggaaggcattttccatccttgaccagcttgtagatgacacacattcagcaaacgcacatcccagcagcaccgagagaacacacaggtgtgtcacgcttttgcgttcataaggccttttcatgtcagtatcttattagatattcccaaacaagggtgttttctcatcttatagaagagaggcctgaggctcacagggtgaaaacaatttgcttaagcctgcacagcagctgtgctggcaacgtttctcccggtataaatgagaagcagcctttgtggccacagagatgtgactgctaagtgcatcgtcccaccctgaaggagattcttcctcaacaagaggacattagtgcaaagactgatgaagtctgtagtttcgtgggttttttttttaagcataaggggttaaatattatgtaattaagtaataaggcagttgtgaggatgcaactgccaaaagtttgaaaaaagctgcccagatggaaatctgcttgcatttgtgcaagcagataggtgagggatttttactgtactgccgtgtcccctacctgccccagctttattgagttataattgacaagcaaaaattgtttatatttaaagtgtacaatgtgatgtggcctttttgttttgttttgagacataatcttatcacccaggctggagtgaagtggcgcagtttaaactgcgcaggctcatcatcctccttcctcagcctcctcagtagctagaaccacaggtgtgagccaccatgcctggctcattttttgattttctttttttaagagacaggggtctccctgtttcccaggctggtcttgaactcccgggctcaagtaatcatcccgcctcagcctcccaaagtgatggtgttacaggcatgagctactgtgcctggccagaaatggtaaattataattaaaggcttctgtaagtc

SEQ ID NO: 1002 - DNA, 3870 bp, Homo sapiens
aattggaatcagcccttcagtggccaatgttattgaaggacagcagcttactttgccctgtactctgttagctggaaatcccattccagaacgtcggtggattaagaattcagctatgttgctccaaaatccttacatcactgtgcgcagtgatgggagcctccatattgaaagagttcagcttcaggatggtggtgaatatacttgtgtggccagtaacgttgctgggaccaataacaaaactacctctgtggttgtgcatgttctgccaaccattcagcatgggcagcagatactcagtacaattgaaggcattccagtaactttaccatgcaaagcaagtggaaatcccaaaccgtctgtcatctggtccaagaaaggagagctgatttcaaccagcagtgctaagttttcagcaggagctgatggtagtctgtatgtggtatcacctggaggagaggagagtggggagtatgtctgcactgccaccaatacagccggctacgccaaaaggaaagtgcagctaacagtctatgtaaggcccagagtgtttggagatcaacgaggactgtcccaggataagcctgttgagatctccgtccttgcaggggaagaggtaacacttccatgtgaagtgaagagcttacctccacccataattacttgggccaaagaaacccagctcatctcaccgttctctccaagacacacattcctcccttctggttcaatgaagatcactgaaacccgcacttcagatagtgggatgtatctttgtgttgccataaatattgctgggaatgtgactcaggctgtcaaattaaatgtccatgttcctccaaagatacagcgtggacctaaacatctcaaagtccaagttggtcaaagagtggatattccatgtaatgctcaagggactcctcttcctgtaatcacctggtctaaaggtggaagcactatgctggttgatggagagcaccatgttagcaatccagacggaactttaagcatcgaccaagccacgccctcagatgctggcatatatacatgtgttgctactaacatagcaggcactgatgaaacagagataacgctacatgtccaagaaccacccacagtggaagatctagaacctccatataacactactttccaagaaagagtggccaatcaacgcattgaatttccatgtcctgcaaaaggtacccctaaaccaaccatcaaatggttacacaatggtagagagttgacaggcagagagcctggcatttctatcttggaagatggcacattgctggttattgcttctgttacaccctatgacaatggggagtacatctgtgtggcagtcaatgaagctggaaccacagaaagaaaatataacctcaaagtccatgttcctccagtaattaaagataaagaacaagttacaaatgtgtcggtgttgttaaatcagctgaccaatctcttctgtgaagtggaaggcactccatctcccatcattatgtggtataaagataatgtccaggtgactgaaagcagcactattcagactgtgaacaatgggaggatactgaagctcttcagagccactccagaggatgcaggaagatattcctgcaaagcaattaatattgcaggcacttctcagaagtactttaacattgatgtgctagttccacccaccataataggtaccaacttcccaaatgaagtctcagttgtcctcaaccgtgacgtcgcccttgaatgccaggtcaaaggcactccctttcctgatattcattggttcaaagatggcaagcctttatttttgggcgatcctaatgttgaacttctagacagaggacaagtcttacatttaaagaacgcacggagaaatgacaaggggcgctaccaatgtactgtgtctaatgcagctggcaaacaagccaaggatataaaactgactatctatattccacctagtattaaaggaggaaatgtcaccacagacatatcagtattgatcaacagccttattaaactggaatgtgaaacacggggacttccaatgcctgccattacttggtataaggacgggcagccaatcatgtccagctcacaagcactttatattgataaaggacaatatcttcatattcctcgagcacaggtctctgattcagcaacatatacgtgtcacgtagccaatgttgctggaactgctgaaaaatcattccatgtggatgtctatgttcctccaatgattgaaggcaacttggccacgcctttgaataagcaagtagttattgctcattctctgacactggagtgcaaagctgctggaaacccttctcccattctcacctggttgaaagatggtgtacctgtgaaagctaatgacaatatccgcatagaagctggtgggaagaaactcgaaatcatgagtgcccaagaaattgatcgaggacagtacatatgcgtggctaccagtgtggcaggagaaaaggaaatcaaatatgaagttgatgtcttggtgccaccagctatagaaggaggagatgaaacatcttacttcattgtgatggttaataacttactggagctagattgtcatgtgacaggctctcccccaccaactatcatgtggctgaaggatggccagttagttgatgaaagggatggattcaagattttattaaatggacgcaaactggttattgctcaggctcaagtgtcaaacacaggcctttatcggtgcatggcagcaaatactgctggagaccacaaggaggaatttgaagtgactgttcatgttcctccaacaatcaagtcctcaggcctttctgagagagttgtggtaaaatacaagcctgtcgccttgcagtgcatagccaatgggattccaaatccttccattacatggttaaaagatgaccagcctgtgaacactgcccaaggaaaccttaaaatacagtcttctggtcgagttctacaaattgccaaaaccctgttggaagatgctggcagatacacatgtgtggctaccaacgcagctggagaaacacaacagcacattcaactgcatgttcatgaaccacctagtctggaagatgctggaaaaatgctgaatgagactgtgttggtgagcaaccctgtacagctggagtgtaaggcagctggaaatcctgtgcctgttattacatggtacaaagataatcgtctactctcaggttccaccagcatgactttcttgaacagaggacagatcattgatattgaaagtgcccagatctcagatgctggcatatataaatgcgtggccatcaactcagctggagctacagagttattttacagtctgcaagttcatgtggccccatcaatttctggcagcaataacatggtggcagtggtggttaataacccggtgaggttagaatgtgaagccagaggtattcctgccccaagtctgacctggttgaaagatgggagtcctgtttctagtttttctaatggattacaggttctctctggtggtcgaatcctagcattgaccagtgcacaaatcagcgacacaggaaggtacacctgcgtggcagtgaatgctgctggagaaaagcaaagggacattgacctccgagtatatgttccgccaaatattatgggagaagaacagaatgtctctgtcctcattagccaagctgtggaattactatgtcaaagtgatgctattcccccacctactcttacttggttaaaagacggccaccccttgctgaagaaaccgggcctcagtatatctgaaaatagaagtgtgttaaagattgaagatgctcaggttcaagacactggtcgttacacttgtgaagcaacaaatgttgctgg

SEQ ID NO: 1003 - DNA, 2757 bp, Homo sapiens
ctcagctcagatccctctttgccggccctggctgacttccaccaggccttctccgttgtcttcctggattcctcaggccatctcaacctctgtgctgatgtcactgcctctacttaccaccaggtacagcatgaggcacggctgtctatgatgttgctggacagcagagctgacggcgggttccacctgctgttgatgactcccaaacccatgatccgggcttttgaccatgtcctgcatctccgtccactgagtcgcctgcaggcagcgtgccaccggctgaagctctggccagagctgcaggacaatggtggggactatgtctcagctgctttgggccccctgaccaccctcctggagcagggcctgggggctcggctgaacctgctggctcactctcgacccccagtcccagagtgggacatcagccaagatccaccaaagcacaaagactctgggaccctgaccctgggactccttctccggcctgagggactgaccagcgtccttgagctgggtccagaggcagaccagcctgaggctgctaaattccgccagttctggggatcccgctcggagcttcggcgtttccaggacggagccattcgggaagctgtggtctgggaggcagcctctatgtcccagaagcgccttattccccaccaggtggtcacccacctcttggcactccatgctgacatcccagaaacctgtgtccactatgtggggggccccctggatgcacttatccaaggcctgaaagagacctccagcacaggtgaggaggccctggtagcggcggtacgttgctacgacgacctcagtcgcctactgtgggggctagagggtctcccactgaccgtgtctgctgttcagggagctcacccagtgctgcgctacacagaggtgttcccaccaactccagtccgtccagccttctccttctatgagactctgcgggagcggtcctcactgctgccccggctcgataagccctgtccggcctacgtggagcccatgaccgtggtttgtcacctggagggcagtggccagtggccacaggacgctgaggccgtgcagcgggtccgagctgccttccagctgcgcctggcagagctgttgacacaacagcatggtctgcagtgccgtgccactgccacgcacacggatgtccttaaggatggatttgtgtttcggattcgcgtggcctatcagcgggagccccagatcctgaaggaggtgcagagcccagaggggatgatctcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctctttgtcaacctcaataatgagctcactgtggaggagcaggtggagatccgcagtggcttcctggcagctcgggcacagctccccgtcatggtcattgttaccccccaagaccgcaaaaactctgtgtggacacaggatggaccctcagcccagatcctgcagcagcttgtggtcctggcagctgaagccctgcccatgttagagaagcagctcatggatccccggggacctggggacatcaggacagtgttccggccgcccttggacatttacgacgtgctgattcgcctgtctcctcgccatatcccgcggcaccgccaggctgtggactcgccagctgcctccttctgccggggcctgctcagccagccggggccctcatccctgatgcccgtgctgggctatgatcctcctcagctctatctgacgcagctcagggaggcctttggggatctggcccttttcttctatgaccagcatggtggagaggtgattggtgtcctctggaagcccaccagcttccagccgcagcccttcaaggcctccagcacaaaggggcgcatggtgatgtctcgaggtggggagctagtaatggtgcccaatgttgaagcaatcctggaggactttgctgtgctgggtgaaggcctggtgcagactgtggaggcccgaagtgagaggtggactgtgtgatcccagctctggagcaagctgtagacggacagcaggacattggacctctagagcaagatgtcagtaggatgacctccaccctccttggacatgaatcctccatggagggcctgctggctgaacatgctgaatcatctccaacaaaacccggccccaactttctctctgatgctccagcattggggcaggggcatggtggcccatgtagtctcctgggcctcaccatcccagaagaggagtgggagccagctcagagaaggaactgaacccaggagatccatccacctattagccctgggcctggacctccctgcgatttcccactcctttcttagtcttcttcctgctgccaggacctgtgcctagacttagcatgcccttcactgcagtgtcaggcctttagatgggacccagcgaaaatgtggcccttctgagtcacatcaccgacactgagcagtggaaaggggctatatgtgtatgaatagaccacattgaaggagc

SEQ ID NO: 1004 - DNA, 3046 bp, Homo sapiens
gtgtgaatgaagctctgccggctacgtggggcgctcactcaacttggtgtcctggacgccagagccgaccgagcgcgctgcccaccggcggcggacacgggctccgccgctccggacctcggcgacagagcaaatcagttgcctggagttcccagtgaagttgtacctgtgcccgtgcgataacgtcagtggaagctgccccgagtttggggctttagccccttggagaaaacagggccacatagctgcctttctatcaagtctccctacaaaactgagaggctctgggaaactcagcctgtgaccccagcgtgggtgaagataggatcaagatggccatgtggcagggtgccatggataacagaggctttcagcaggggagttttagtagcttccagaacagctccagtgatgaagacctgatggacattccagcaaccgctatggatttctccatgagagatgatgttcctcccttagaccgagaagtaggagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagagattaccaataaaagcaaagagtcaacatgggccttaattcacagtgtgagtgatgctttttccggctggttgttgatgctccttattgggcttttatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgagggagcctttgcctacatagtcaattatttcatgtacgtcctctgggctctcctatttgccttccttgccgtatctcttgtcaaggtgtttgcgccttatgcctgtggctctggaatccctgagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtcttgtcggctgcagcagcagctggtgtatctgtagcctttggagcacctataggtggagtattattcagccttgaagaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattgaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggcgattgcttggaatcattaccaaaaaggatgtgttaaagcatgtagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattat

SEQ ID NO: 1005 - DNA, 2685 bp, Homo sapiens
aagatggccgaataggaacagctccggtctacagctcccagcgtgagcgacgcagaagacgggtgatttctgcatttccatctgagttaggcttggccacaagagacaaattgcaaggcatggagacatttttctaacacttgaaaattctatgcaagagcaccaggcagctcagtcaccttgtcacttatctactgggtcaccttgttggcatgggatgccagccaggcttgcagctgctccatcctcccctgaatttgtacttcagcttctccactcatggcctgccctgaggacttcatggttcagcatcagatatgaagacgacagccctatagagactatttaaccagcttctaaggtggttaaatatcttaccagcctatgtaaggccgaatcctactaacaaagcactggtatatgtaatatcccagtggtttgcttctctaattgaaccctgactactacagaagtccagataccacagtctgagtagttctttaatctgcttatctggtgattccatcacaaatggttcagttgggcaaaaggctccagtgaagagctgtgaggcttatgtatggggactcaccaggggccagcccaggctgcccacaagaccatgagccaccctgtgactgaatgaagtggagagaagggaaagtagttaagaaatcaagaaaagtgtctttcagcaccatggccagaagttgtgccacagaattggaacagggaaacccagagagccagtgctgtcctagtcctagtgctgaatgatcccattggtgtccttagaagggctctgacttcagcccaccagcagcatgtggacttataagctttctagcagagttggagatccccaggaaaaagaaatctcttaaaatgaaatgaaacttcaatcaaccaaggctttctagcctgatgtgagttgtctttacacacatatacctttttaacaaagaagaagaaaagaatggacattgatagaacttgcattctgtgttcatcaccaggatagttgctttataaatatcattttgtttttagtcacaacccaatgcagcattttccttactgacaaagaacctgaggcatggagaatttaagcaactccctgaaggccacccagctaatcagcagtgggaaaagaatttaattctagatctttcattctaaagcccagctccttacacacgttggatgctactatttccaaaatgtcaacaacactttggactatcaacctgtctaaagagtatttgaagcagtgatgcaggcctctgaaggaaaaggtgcacattttcaacaataaaagagagacattcctttagtgtatctccacattccctgaaggggagctggaatgacatgacggacttggcctcagggccccaagccttccctgttgcagtcttcatgacactcctcagaagcagcaactccagccatgtctggaaccattccttaccagacaggaggatatcatggcctcaactcatgatctgtaccaagccaaacctcttttggggtacccaccaagcctcaggcctcaccttctctgccctgttgtccctgcccatctgtcctggttttctactagtttccactactggacacttgtctgaggctgggtccccacctggatcttgtggcctcttgcccagggcttggagggaagctgctcccacacttgaagatgacagctgagcatggtcctttgtgggcgtgctgtcaggaagatgacagtgcaatctgtttaatgtgccagttgtctctgtgagtccctcatccggatgagcacttgtcacacccctgcagagccccagctggttcttagagaggtgctccagctctgtgattacctaatctggcttcccaatctatcccacaatgtgtcattgctgaggtccctgtgggtcttgcagataaacttgctacagtcatcctacacaaaaaagaagctcgttatcatgaaaccggcctgctttttagctcctgggccctaactcaccccagattgctgccagctcttttgttttcccacttagaccaaagggattgagaagctttcccattccttggagctgccaccctccattctaaggcagtctcccccttcaccctgcttgctgcaccccagatgctgcaaggcccatgtgctgtttttgacttcagtacttcagattgctgtgggaacacaggaggcagcagccagatgagaaattgagtctgactctggagtattataaagtccttatagttactggcattaggtatagggtctgtattattaaagagaaattattcaccaaacacttgttaaaaatggcaagacagtttatttaagagcattgcaataggtaagtgctatggtctcaatgtttgtgtctccctcaaattcataagttgaaacttcacttccaagatgaaggaattaggaggtgggcactttaagggatgattatgtcataggccagagccctcatgaacgagatcagtgcccttctaaaagaggcattgggagagacccctcaccttttccatcatatgaggacacagccaggaagcatcatccacgaaccagaaaattggcccttaccagacactgaatctgctgatgtcctgaccatggacttctgagccttctgaactgtgagagataaatttctgttgtttataagc

SEQ ID NO: 1006 - DNA, 3014 bp, Homo sapiens
caaaccgctacggcgtttgaaagtgtccgggttgcttaggatccctacaggtagcgcctctggatacatgcgtggtctgctgacccagagagaaacgaaagcagaactgtttggcgggagatcatgtcagccgtggtagctcagacgctgcatgtttttggtcttcgatcccacgtggccaacaatatcttctacttcgatgaacagatcattatatttccttcaggaaatcactgtgtgaagtacaatgtggatcagaaatggcaaaaattcattccaggctcagagaagagtcagggcatgttggccttgtccatcagtcccaatcggcggtacctcgctatctctgagactgtgcaagaaaaacctgccatcaccatttatgaattgtcatccatcccttgccggaagcgcaaagttcttaataattttgacttccaagttcagaaatttattagcatggctttttctccagactccaaatacctattggctcagacgtcacctccagagtcaaatcttgtctactggctgtgggaaaaacagaaagtaatggccattgttagaatcgacactcagaacaaccctgtctaccaggtgagcttcagtccacaggataacactcaggtgtgtgtcactggaaatgggatgtttaagcttctccgttttgctgagggaaccctgaagcaaaccagctttcagaggggagaaccccaaaactatctagctcacacctgggtggctgatgacaagattgtcgttggcactgacacaggcaaactcttcctctttgaatctggagatcagcgttgggagaccagcataatggtcaaggaacctaccaatggctcaaagagcctggatgtcattcaggaatcagagagcctgattgaatttccaccagtcagttctccactcccttcctatgaacagatggtggcggccagtagccatagccagatgtccatgccccaggtgtttgccattgcagcctattcaaagggatttgcctgttctgctgggccagggagagttctgctgtttgagaagatggaagaaaaggatttttaccgtgagagcagagaaatcaggattcctgtggacccgcagagcaatgatccaagtcagtctgacaaacaggacgttctctgcctgtgcttcagcccctcagaggaaactctggttgccagcaccagtaagaaccaactctacagcatcaccatgtccctgacagagatcagcaagggggagcctgctcactttgagtatttgatgtatccattgcactcagcacccatcaccggtctagctacctgcatccgcaaaccccttatagccacctgttctctggatcgatccatccgcctttggaattatgaaacaaacaccctggaactatttaaggaataccaagaagaggcatattccatcagccttcatccatctggacacttcattgtagtagggtttgctgacaaactacgcctcatgaatctactcattgatgatatacgttctttcaaagaatactctgttagaggatgcggagagtgttcctttagcaatggaggtcacctgtttgctgcagtcaatggaaatgtgattcacgtttacaccaccacgagcctagagaacatctcaagcctgaaaggacacacagggaagattcgctcaattgtgtggaatgcagatgatagcaaactgatttctggtggcacagatggtgctgtgtatgaatggaatctgtccacaggaaagagagagacagaatgcgtgctcaagtcttgcagctacaactgtgttactgtctcccccgatgccaaaattatctttgctgttggatcagaccacaccctcaaggagattgcagattccttgatccttcgagagatatcggcgtttgatgtcacctacaccgccattgtcatctcacattctggacgcatgatgtttgtgggcacctcggtgggaaccattcgtgccatgaagtaccctctgcctctgcagaaggaattcaatgagtaccaggcccatgccggtcctatcaccaaggtgagcaggaccctctccccaggaacccagtcccacacctgcctgctacgtgccttgttcatcccttcaacctcccaatgtcttttctctctccttcttctctcttatttattcatccatcattcattgaatcaccatctattgactatgaatatactctttgtttaaactacttccaggaatttagcctaggaaatcatcagagatacacctaaaaatgtatgtacaacgttttcaccataatattatgcataataaggggccgtttggtggatgccgtagctgccgtgagtgtgggctgcacttgaccacagctgcctcctcctccagagaatgccccagactgaaaggagccatagccctgaagattggcccctacctctccctgagggtacaaaaggccaccccaggggcaataccatgagtacacatttgtaaattgtccttccattcacccttctcataaagtagtatctatgttcaacagtcaaaatgtggaagcaaccaagcatccatcgacagacgaatgcataagcaaaagatggtatatctatacaatggaacaataccctgcctaaaaaggaagggaattctgcaatgtgctaccacatggatgaaccttgaggatgttatgctaaattaaataaggccaaccacaaaaagataagtacagtgtgattccacttttaggagatacttagagcagtcagaatcacaaagacagagtggtggttggcaggggctgcaggaagggggaatgaggaatgattgtttcataggtatagagttttggttttacaagacaaaaggattatgggggtagttggtggcaatggctgcacaacattacaaatgtatttaataacatgaactgtacacttgaaaatggttaagatagcaaattttacagaatatgtattttacgacaattttaaaaatgaaataaaaaagaattatcttgc

SEQ ID NO: 1007 - DNA, 3608 bp, Homo sapiens
agagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaactcgcaaaacaccctttgtgaagcctccagagatgaacaggccttcttgggaaaggacaaaaaaattcctggaaaaagaagtccaagaagcaaaaaagggactgctaagaagataccaccaggacttttttcaggagatattgcacctttaatgcaagaaaaagtactaagcgcagtcacatatgctgttgatgatgaagaagctgctgaagtaaatgctaatgagcagccagaggcgccaaagcttgttctgcagtctctgttttcacttatacgaggtgaagttgagcagttggattcaagagcacttcccctttgccttcatcagatagcagaatcctatttccaggaggaggactacgagaaagcaatgaaattcattcagctagaacgattgtatcatgagcaattgctcgcaaatctttctgccattcaagaacagtgggaaacaaaatggaaaactgtgcaaccacatacagttacggctctaaggaattcagaaaagggatttaatggtgaagattttgaacggcttacgaaaatttgtgcaacacatcaagatcctcttttatccaaacataagatagcagctgtggagaagtcccaggaaaggaaatgctccacgcagttactagtgtctgaagatccaaaggaaggaggagctaccaccaaagagtcagagagtaaaacttgtctcggcacagagtcaagtaaagaaagccaacatacagtggagcccctggggagcagtccctgctgtcatcagatggacgtgcaaacagattccccaagcctttcggtaactgcaggaaaggaccacatggaggagctgctctgcagcgctgaagccacgttagcgctccacacccagtcctccgagacagcagggagcccgtctgggccagactcttctgaggatgcttgtgaggatgacagtcgcttgcagctggctcaaacagaggcctgccaggatgtggccagaatagagggcattgctgaagaccctaaggtgtttctttccagcaagtcaaagacagagccgttgatttcaccaggctgtgaccgtatacctcctgcattgatttctgagggtaaatattcacaggctcagaggaaagaactccgtttgccacttcgggatgcttctgaggcgttgcccacagaccaacttgagaacaatgaattaaatgagctgcagcagcctgatcttacagacagtgatggaaaatcaccacaggcgcaggctgactcagacggttctgagaatgtgctctgtggaaataatcaaatatctgacttaggcatactgcttccagaggtgtgtatggccccagaggaaaagggagataaagacgaccaactcaacaaagaaacagaagactatttgaacagccttttagaaggatgtttaaaagatactgaagattccctttcctatgaagataaccaagacgacgactccgatctccttcaagatctctctcctgaagaagcatcctatagtctccaggagaatctgccttctgatgagagctgtctttctcttgatgatcttgccaaaaggatagagattgcagaggttgttcctactgaaggattggtctccatattaaagaagaggaatgatactgtaggagatcatcctgcccaaatgcaacacaaaccatctaagcgaagagtgagattccaagaaatagacgatagcttggatcaagatgaagttggaggtggctcctgtattttgctggtcttgctgtgcatagcaacggttttcctcagtgttggaggaactgcattatactgcactttcggtgacatggagtcacctgtttgtactgactttgcagacaacatggacttctattacactaagttacttcagggagtggcagaactgaagcactggatctacctctcctagcagcattccagacacagacatgctggcagtgagagtgaaaggcgggagactttctaaacagtttttctttcaggaattctgtagcattcccccttccctctgttaggaaccaaggacatcagaaatagcaactttaagtggcaagccggaggaactctgttagaataatccacacagtgaggcaaatatcaatctaagcattgtggatggaaggaatggtctttggagagagcatatccatctcctcctcactgcctcctaatgtcatgaggtacactgagcagaattaaacagggtagtcttaaccacactatttttagctaccttgtcaagctaatggttaaagaacacttttggtttacacttgttgggtcatagaagttgctttccgccatcacgcaataagtttgtgtgtaatcagaaggagttaccttatggtttcagtgtcattctttagttaacttgggagctgtgtaatttaggctttgcgtattatttcacttctgttctccacttatgaagtgattgtgtgtttgcgtgtgtgtgcgtgcgcatgtgcttccggcagttaacataagcaaatacccaacatcacaaagatgatctttcttcttttaacttgatgatgatgtgcaggcacaaatctttggagaaggcttaactgtggaatagatgaattctagaactcttgaccctgcaatgagaaactgtgacagatctgtgtcaattaacttgattagccagaaattaatcacaggcctagagaccaaagaaaaagctcccctgagtctcaggcaacagttttgtcacggatgcaaagcttcctgaaatcatgaatgctggactcagtttggcaaacgcttacacctattatgttctgagattctgagaaccagaatgcaaacttaagtaagatacagttcccactgtaggtgttttaatcctggtcttatatagaataaaccagtactttgctgagtgaaatcaccatatagaattcagtattaacagatcatgcattcagatgcttgaatgtgcattcttgttgtgggcttgatttagatcctattgcggggtcattacgcaaaaattcaatcataccttccatagacaaatgtctgatttttgtttaaatctgtccgttaggtggcctttccttatctgaggtgtagtggtctaacatttaggaagccttgctttgactttatcgggcagcatt

SEQ ID NO: 1008 - DNA, 3482 bp, Homo sapiens
gaggtgccggcggctggcggccgcggagtcttcggcgagacctaccgggccctgtctgtgccggccgtgagctgcggcaggacggctggagattacttctctaacaggatcaccagtttgctccacaaagcacaatgtctcgatcacgacaacccccccttgtgaccgacatctctccaaatgaagggataccatggacgaaggtcacaatcaggggagaaaatctggggactggccccaccgacctcataggcttgaccatttgtggacataattgcctcctgacggcagaatggatgtctgcaagtaaaatagtatgtcgagtgggacaagccaaaaatgacaaaggagacattattgtcaccactaagtcaggtggcagaggaacctcaacagtctctttcaagctactcaaacctgagaaaataggcattttggatcagtctgctgtgtgggttgatgaaatgaattattatgatatgcgcactgacaggaacaaaggaattccgcccttgtccttacgtcctgctaacccgcttggcattgagattgaaaaaagtaaattttcgcagaaggacttagaaatgctattccatggaatgagtgctgattttacaagtgagaatttctcagcagcctggtatcttatagagaatcactcaaacaccagttttgagcagctcaaaatggcagtcaccaacctaaagagacaggctaacaagaagagtgagggcagcctggcctatgtgaaaggcggtctcagtacattcttcgaagcacaggatgccctctcagccatccatcaaaaactagaagcagatggaacggaaaaagtagaaggatccatgacgcagaaactggagaatgttctgaacagagcaagtaatactgcagacacattgtttcaagaagtattaggtcggaaagacaaggcagattccactagaaatgcactcaatgtgcttcagcgatttaagtttcttttcaaccttcctctaaatattgaaaggaatattcaaaagggtgattatgatgtggttattaatgattatgaaaaggccaagtcactttttgggaaaacggaggtgcaagttttcaagaaatattatgctgaagtagaaacaaggattgaagctttaagagaattacttctggataaattgcttgagacaccatcaactttacatgaccaaaaacgttacataaggtacctgtctgaccttcatgcgtctggtgaccctgcttggcaatgcattggagcccaacacaagtggatccttcagctcatgcacagttgcaaagagggctacgtgaaagatctgaaaggtaacccaggcctgcacagtcccatgttggatcttgataatgatacacgtccctcagtgttgggccatctcagtcagacagcgtccctgaagaggggcagcagctttcagtctggtcgagacgacacgtggagatacaaaactccccacagggtggcctttgttgaaaaattgacaaaactcgtcttgagccagctgcctaacttctggaaactctggatctcctacgttaatggaagcctcttcagtgagactgctgagaagtcaggccagattgaaagatcaaagaatgtaaggcaaagacaaaatgattttaagaaaatgattcaggaagtaatgcactccctggtgaagcttacccgcggagccctgcttcccctcagcatccgggatggggaagccaagcagtacggaggctgggaggtgaagtgcgagctctccggacagtggctcgctcacgccatccagactgtaagacttactcatgaatcgttgactgcccttgaaattcctaatgacctgttacagactatccaggatctcatcttggatctccgagtacgttgcgtaatggccacgttgcagcacacggcggaagaaataaagagattagctgaaaaagaagactggattgttgacaatgaaggactgacttctctaccatgtcagtttgaacagtgcatcgtgtgttctctgcagtcactgaagggggttctggagtgcaagccgggagaggccagtgtcttccaacaacctaaaacacaggaggaggtttgccagctaagcatcaatataatgcaggtttttatatactgtctggaacagttgagcaccaagcctgatgcagatatagatactacacatctctctgttgatgtttcttcccctgacttgtttggaagtatccatgaagacttcagcttgacctcagaacagcgccttttgatagtcctaagtaattgctgctatctagaacgtcacaccttcctaaatatcgcagaacattttgaaaagcacaacttccagggaatagaaaaaatcacacaggttagcatggcctcattgaaagaactagatcaaagactctttgaaaattacatcgagttgaaagcagatcccatcgttggctccttagaacctggaatttatgcaggatattttgattggaaggactgcctgcctccaacaggtgtcagaaactatttaaaagaagcactggtgaatataattgccgtgcatgcagaggtgttcaccatttccaaagaactggtccctcgggtactatccaaggtgatagaagcagtttctgaagagctcagtcgactgatgcagtgtgtttcatccttcagcaaaaatggagctttacaggcgagacttgaaatctgtgctttgagggacactgtggctgtttacctgacacccgaaagcaagtcaagttttaagcaggctttggaagccctgccccagctttccagtggagcagataaaaagttactggaagagctcctgaacaagttcaagagtagcatgcacttgcagctcacctgtttccaagcagcttcttcaaccatgatgaaaacataaatatctgccacataaaagaagtccaggaaagtaacacgtaataagactgttcactctctaagtaccctaaaggtatttggtgtattaaacattgggtttgccatttttctcttttttcttcctctgacttcgaaaattgttggtatacatttcaaccaaaatgacctcatttgaaatgcccaggaagtatttgttttgccattcttactagatcagatcctgtatgactttaaaatacattttaaaatatattttgcatctcagcagaaggttgagtgctgcaggaagagctgcttctgcagggagttttctggaatggcgtggcacatattgaagcatttctcagtgtcccgttcacggaagcgcaggcagctcccacgacacacggagagactgactgatacgagatttggaaagctatgtagacatctttggagctcttactgtcctaaactgtacagctgtgcttaaaaccctcatttcatataaatggccttaagttttctaattcaagcgggtttttggaaaaatttatggtctccattaaaatacatattacaactggggtagatt

SEQ ID NO: 1009 - DNA, 3108 bp, Homo sapiens
agcgttcccggggccttctggagagaggcagggtcccgccgccccggttcccgcaggaatcagctggagaaaggcgggcggcttggggctgaacttcctccacccccccatcccccccgccgcctggagcagacacgtcgccgccgcgcccctgggaacggtcagggaagcaagcagaagccgggaagccgcgaaagaggcgaggaagtgcgaccccctccccagatccccggtcccccgtcgaaatccctgtcggccggtcaaaccctagacaatggaagctccacgttttcatcctcattctcccccacaagtccggtcgcgggttcccctcggcccgggaccccggcgccagccccggagtcggagcctgcacgatacgccccctcccgccgctccacttctccacccggagatcgctcaccccctccgccccatccccccatttcccgcttggccggccccgcccgacccggaggcggcgccccctcccctgtcccaggcccaggaaggaggacggcggaggaagtagggggtcctggctgcgggcgcagggatgtgggtcggcgatcggcgtccgagggcgtaaaaaggcggcccgaggactgcgcgcgggcgggcagcgcgggaagccgggaagaaaggagggcgcgcgggggaggaggctgcgggtgcggggcccgaggccggggcgctcactttctcgcgccgctcgcgctcgccgtccagctcccgctgcaggccctgcgcgcggtcttccgcctcgtccgcctgctgctgcagggcctggatcttgcgtttcaccgcctccagggagttgaggccggccatggcgcggaggcgcagaggcgcacgggcagcggcggacgctcggctgggctcggctccggcgagagctgcacagccgcgccccggccccccaagcctttgcctgcgcgggggccgcccccgcctctccccgccccccgggccggctgccgtcggggcgatgaggtcacccggccggaccgccgacgtcagcaccgctgggggagggcctgacgtcggcaccgctggccacagctgctggaaagtgccccttttcgggacttatttggagaaagcgctgggaggcgccgccttctcctcctcctcttcctcctccccctgcggctctccccgccttcccggccccggggctccggcctggccccgccgcgggctcccgcatccctgcacacgtacgtcggaggccttcttctccgtgagctccagcttctcctgcgcgtccttcaggtcctcggaatatttatccagctcgtcctctgtcccttttagtttcttctggaggtgcgtcagctcctcctccacctggggacgacagagcgaggaacgggtcagcctggggggggtgggtcacgtccccgaggtgcaggggcggtcccccccaatattcacaagagtcctccgtctctctctgggcatcagtttccttatctgtagaacaggggttgcgatagcatgcaccacgccatccatgctacctgatagtgggattttcacatctttccctcgtcctgaggaccagctgttttgggcttattggggtccccagtactctagggagatcaatggcagcttttgggaaactgaagactccaaatgttttccagaaatacacacattccagtttcagaggtgcagcctcaccatgatctggagttaagcaatctcattctctgcgcgtggatccctccgcccatcactgtccccagcctttctccctctggttctgaccccaacacggggtcagagaaactttctaacaaatacgcctgccctctttctgcctagaacctgctatggctccctatggcccaaggcagtggttcttagactgtcttaccaaaatactctgaagggctgaagggctcagacctagtccctcatttctgggctttggggagcttggctagaagagactcgcccctacaggatcactttctttgaaggctcgggttaaatctttaaaatttttgcatataggccatgttcattttaataaaaatgtcccctactttccctaaattttcagtcctctgtttatcccaagagtcctatcctcccatcactcctagtttgagaagctcaggcctatggattacaaaccacagaccccatcacctctctttgtcaccctccaccacaccggtctagagttggctcaagaagacttttctgtcacctccaggctgaaactccctccctgggcccccaactctggattagggtgatcatatccagctcatgcctggatctgacttttttttttttgagagtctcgctctgtcaccaaggctggagtgcagtggcacgatctcagctcactgcaacctccgcctcctgggttcaagtgattctcctgcctcaacctccccggtagctggtactacaggtgcacaccaccacgactggctaatttttgtattttcagtagagacagggttttgcaatattggccaggcaggtctcaaactcctgacctcaagtgatctgcccgcctcggcctcccaaattgctgggattgcaggcgtgagtcgccacacctggcttggatctgacttttgccttagatggtttgacactgatcttgttcctgctcccagggtgggcagacagcccccactgagcccagcttcattctcctgcttcctccccacagcaggaggctcagagaggtgggatgactttccccaggtcacacagcacagggtttgagcccaggtcttctggaatataagcctataatgaaatgaatgcttgcttttgccccctctccaattcatgtgttgaagccctcgtctccatgtgatggtaattggtgttggggcctttggaagatgatgaggtttgggtgaggtcatgagggttgacccaccatgatgggattaaggcccttatgagaagaggccagaacttggttatcctcttccaatgtgaggacacagcaagaaggtggctgtctgcaagctagctagagagccctcaccagacatttaatctgccagcatcttgatcttggacatctagcctccagactgtaaacaataaatgtctattattgaagct

SEQ ID NO: 1010 - DNA, 2593 bp, Homo sapiens
taaaaatgcaattcactcacaactctaaatgataattgacatttcagcctctttcttttaggcaaaacagaagatacacactattaacagttatttgaagccttaaattacaatagcctgttaggtgatcggctttctgccttggctttctgatgcagcacattttaagatttgcctttaaagctttgagccttgagattaggttagttaggaagaggacaacaaagggaagagattattctaataaaacttccacagagggaagaaaattgaggagcttcagatctctaaagccaaattcaacctgatctttctaggttggttataaagctggtccacttccaggaagtgatgtgtaggtgaataggaacaaaaggtgaagaagcagtaaaactgtgaccaagcggccagatggggcttttgccggctgattgaaaggaagtctacagacctaacataagcagtcagccaaaggtggctgtgggaggttgatttcttccagaaacttccaagttgtggctacaaatttattgccagatattttcccactgagaatactgaggttattcacataatcacttccttaacaaaggaagaagcacttttaacttgggctgcattccctttgtgagggtccacatttaggatcctcctgctaccataaggccccttttggggttctttgggtgtggctgcatctcaccatgttgaggattgcctttttttttttttttttttttttttttttaacacagagccttgctctgtctcccaggctggagtgcagtggtgcgatcttggctcactgcaacctctgcctcccaggttcaagcaattctcctgcctcagcctcccaagtagccggaattacaggcatgtgccaccatgctgggctaatttttgtatttttagtggagacggtgtttcaccatgttggccaggctgttcttgaactcctggcctcaagtgacccgcccacattggcctcccaaagtgctgggattacaggcgtgagcccccgtgcccagcaaggattgctgttttaattcttgtatcttcgttgcttctttggtctttgcttaaacaaaacaataaagcttaatagttggggagaatgctgttaccagtgtcctctaggaaggctgttagcatatggctctactgagcagcagtgccatctggtgcctgagatcatgtgcttcaggcagttgtcacactgcatctacagccaagcatcacagaaacacttcactcatgtggtcagggaaggtgggactgattcacatgttagagacaggtcagatgggaaaattaaggcccaacttggtgttggggaataaccatactctggtctttcaagtgtagtagctgatgattcccaagaaactgatgaattttctgagtccagacaaaatttccccaagcctgctctctctgttggatatacataatagagaaagtcaaatcagccctttggggtttgtggtaaaaattcactcacccattgaagcctaaggtggctttgtaccttccagatctctcagcaaatcccctgggcagaaatgtcacctgcttgccatgtctttgaggggttcaggtcagcctggagaacaggctccttaggtcaaaaaccttgttttaagagccactgtggtacagtcaatgtaacccacttgtgcagaagccatgcttccaaagaaggtctcaggttgacaactagacatcaaatctgagaagccaactgtggagtaatgtgtttttttctctgtggacaagagtgatcagaaaggtgcttgatcttgaacaattgatccatgatgtaaaaatgaccattagctctcccccagaagcgtctgtgtttgctgaatggagctgagattttgatccgctatcagactccagaaagatccaggagttccaagaacatggcaaagagtcaaaatcttaggacaaggaattaaaatgccagaatgcaaatgtccaacaggcctggtagctcacagctatcaacaccctagaattccacactgcctcactgcagttgctcaaggatgggtatgtttctgtctctgaaattcgggaaaaagccttaagtgccagagaaggtgcttccaagactgtctgcagaattcctttcctagggtctgtctctggtacccaaaagggcagagaaggaaccctaagattagcatagagccactcatctctcctcccttccccaccccttcttcccctgcttccattccccatggctctctcctctgactgtgaaacacttcctctccagcagtgttgggaaggttctggacctctactggatctagccataaatggtggtcttcagaaaaatggagattgtggctgccagcacccacaagacagcagcctcatgccatgcaggcagcaagccatcctgaacagcgttcctcccagagtctgtttcctcacctgctgttcactggtgagaggaaaagggacttgttctcccttgaccagttttctagttttcctgttcccaccctggtctttgcctgatgacagagaaactttctaaaaaaaaacaaaaacaaaagctataaaaaatctgcaaaac

SEQ ID NO: 1011 - DNA, 3278 bp, Homo sapiens
ccatctatgatgccatcaaggaggtgaacctggcggctaccacggacaagcggacatccttctacctgcccctagatgccatcaagcagctgcacatcagcagcaccaccaccgtcagtgaggtcatccaggggctgctcaagaagttcatggttgtggacaatccccagaagtttgcactttttaagcggatacacaaggacggacaaggtaggagaaagagtgaacccaaccagaccgttcccttcctacctgtgtccaagcccacccactaaaactcctgccggccttgggtgggagctgtgggcttctcctgagcaccaggggtccagctgcccatgtggtgttcagatctgtggaatccgggcagggaggcaagagcagagtccctgactctgcatgtgacttcaggaaaaccacaccctaggctcccatttcctgatctgtgcaatgggaggaatctgccccaccattcctaatctttcaggagatgatgtgaatggaatcatgctttaaactctgagcagacacccaagataaaaggttattgccctgttcattactgtcatgttcatttcattaaaaggcccgtgtctacttccagttgtacgtaccccacctctgcatttccaatcctttcccgcaagcctgggccccgcccttcttttctgggaagagctcccagcaccctctcttggtttgcagtgctcttccagaaactctccattgctgaccgccccctctacctgcgcctgcttgctgggcctgacacggaggtcctcagctttgtgctaaaggagaatgaaactggagaggtagagtgggatgccttctccatccctgaacttcagaacttcctaacaatcctggaaaaagaggagcaggacaaaatccaacaagtgcaaaagaagtatgacaagtttaggcagaaactggaggaggccttaagagaatcccagggcaaacctgggtaaccggtcctgcttcctctcctcctggtgcattcagatttatttgtattattaattattattttgcaacagacactttttctcaggacatctctggcaggtgcatttgtgcctgcccagcagttccagctgtggcaaaagtctcttccatggacaagtgtttgcacgggggttcagctgtgcccgcccccaggctgtgccccaccacagattctgccaaggatcagaactcatgtgaaacaaacagctgacgtcctctctcgatctgcaagcctttcaccaaccaaatagttgcctctctcgtcaccaaactggaacctcacaccagccggcaaaggaaggaagaaaggttttagagctgtgtgttctttctctggctttgattcttctttgagttctcttacttgccacgtacaggaccattatttatgagtgaaaagttgtagcacattccttttgcaggtctgagctaagcccctgaaagcagggtaatgctcataaaaggactgttcccgcggccccaaggtgcctgttgttcacacttaagggaagtttataaagctactggccccagatgctcagggtaaggagcaccaaagctgaggctggctcagagatctccagagaagctgcagcctgccctggccctggctctggccctggcccacattgcacatggaaacccaaaggcatatatctgcgtatgtgtggtacttagtcacatctttgtcaacaacctgttcgtttttaagttacaaatttgaatttaatgttgtcatcatcgtcatgtgtttccccaaagggaagccagtcattgaccatttaaaaagtctcctgctaagtatggaaatcagacagtaagagaaagccaaaaagcaatgcagagaaaggtgtccaagctgtcttcagccttccccagctaaagagcagaggagggcctgggctacttgggttccccatcggcctccagcactgcctccctcctcccactgcgactctgggatctccaggtgctgcccaaggagttgccttgattacagagaggggagcctccaattcggccaacttggagtcctttctgttttgaagcatgggccagacccggcactgcgctcggagagccggtgggcctggcctccccgtcgacctcagtgcctttttgttttcagagagaaataggagtagggcgagtttgcctgaagctctgctgctggcttctcctgccaggaagtgaacaatggcggcggtgtgggagacaaggccaggagagcccgcgttcagtatgggttgagggtcacagacctccctcccatctgggggcctgagttttgactccaatcagtgataccagaccacattgacagggaggatcaaattcctgacttacatttgcactggcttcttgtttaggctgaatcctaaaataaattagtcaaaaaattccaacaagtagccaggactgcagagacactccagtgcagagggagaaggacttgtaattttcaaagcagggctggttttccaacccagcctctgagaaaccatttctttgctatcctctgccttcccaagtccctcttgggtcggttcaagcccaagcttgttcgtgtagcttcagaagttccctctccgacccaggctgagtccatactgcccctgatcccagaaggaatgctgacccctcgtcgtatgaactgtgcatagtctccagagcttcaaaggcaacacaagctcgcaactctaagatttttttaaaccacaaaaaccctggttagccatctcatgctcagccttatcacttccctccctttagaaactctctccctgctgtatattaaagggagcaggtggagagtcattttccttcgtcctgcatgtctctaacattaatagaaggcatggctcctgctgcaaccgctgtgaatgctgctgagaacctccctctatggggatggctattttatttttgagaaggaaaaaaaagtcatgtatatatacacataaaggcatatagctatatataaagagataagggtgtttatgaaatgagaaaattattggacaattcagactttactaaagcacagttagacccaaggcctatgctgaggtctaaacctctgaaaaaagtatagtatcgagtacccgttccctcccagaggtgggagtaactgctggtagtgccttctttggttgtgttgctcagtgtgtaagtgtttgtttccaggatattttctttttaaatgtctttcttatatgggttttaaaaaaaagtaataaaagcctgttgcaaaaatgactcatgtt

SEQ ID NO: 1012 - DNA, 3726 bp, Homo sapiens
tttttctgcgacgttccaagtgaccgatattccagagtggtatttacttcatctggaggggagacattatggaatttacctgcaattaaatcaatgtgcaatgtagataattccaggatcagatctcatccccagtttggtgatctctgccagaggaccactgctgcctcctgctgccccagctggacactgggaaactacatcgccattctgaacaatagatcgtcctgtcagaaaatagttgagcgagacgtttctcataccttgaagctgcttcggacttgtgccaaacactaccaaaatggcactctggggccagactgctgggacatggcagccagaagaaaggaccagctcaagtgcaccaatgtgccacgcaaatgtaccaagtacaatgctgtgtaccagatcctccattacttggtggacaaagactttatgaccccaaagacggctgactatgccacgccagctttaaaatacagcatgctcttctctcccacagagaaaggggagagcatgatgaacatttacttggacaactttgaaaactggaactcttctgacggcgtgactaccatcaccgggattgagtttggtatcaaacacagtttgtttcaggattatcttctaatggatactgtgtatcctgccatagccattgtgattgtccttttagttatgtgtgtctacaccaagtccatgtttatcactctgatgacaatgtttgcaataatcagttctttgattgtttcctattttctctatcgtgtagtatttcacttcgaattttttccttttatgaacctcactgccctcattattttggttggaattggagcagatgatgcttttgtcctgtgtgatgtttggaactacacaaaatttgataagcctcatgccgaaacctcagaaacagtaagcatcaccttgcagcacgctgccctctccatgttcgtcaccagttttaccactgctgctgccttttatgctaactatgttagcaacattacagcaatccgatgctttggggtttatgcggggacagctatattggtgaattacgttttgatggtcacatggcttccagcagttgttgtgctgcatgagcggtatcttcttaatatattcacttgcttcaaaaagccccagcagcaaatatatgataacaaaagctgctggacagtggcttgccagaagtgccacaaagtactctttgccatttcagaagcatctcgaatttttttcgaaaaagtattgccatgcattgtcattaagtttcgctacctttggctgttttggttccttgccttaactgtaggtggggcctacattgtatgtataaatccaaagatgaaactgccctcactggagttatccgagttccaggtgttccggtcgtcccatccttttgagcgttatgatgctgaatacaaaaagcttttcatgtttgaacgtgttcaccatggcgaggagctccacatgcccatcacagtaatctggggcgtgtccccagaagacaatggcaacccactaaatcccaagagtaaagggaagttgacattagatagcagttttaacatcgccagcccagcttcccaggcctggattttgcacttctgtcaaaaactgagaaaccaaacattcttttaccagactgatgaacaggacttcaccagctgcttcattgagacattcaaacagtggatggaaaaccaggactgtgatgagcctgccctgtacccatgctgcagccactggagcttcccctacaagcaagagatttttgaactgtgcatcaagagagctatcatggagctggaaaggagtacagggtaccatttggatagcaaaaccccagggccgaggtttgatatcaatgatactatcagggcagtggtgttagagttccagagtacctacctcttcacactggcttatgaaaagatgcatcagttttataaagaggtggactcgtggatatccagtgagctgagttcggcccctgaaggcctcagcaatggttggtttgtcagcaatctggagttctatgacctccaggatagcctctccgatggcaccctcattgccatggggctgtcagttgctgttgcatttagcgtgatgctgctgacaacttggaacatcatcataagcctttatgccatcatttcaattgctggaacgatatttgtcactgttggttctcttgtcctgctgggctgggagctcaatgtgttggaatctgtcaccatttcggttgccgtcggcttgtctgtagactttgccgtccattatggggttgcctaccgcttggctccagatcccgaccgagaaggcaaagtgatcttctctctgagtcgcgtgggctctgcgatggccatggctgccctgaccaccttcgtggcaggggccatgatgatgccctccacagttctagcttacacccagctgggcaccttcatgatgctcatcatgtgtatcagttgggctttcgccaccttctttttccagtgcatgtgccggtgccttggaccacagggtacctgtggtcagattcctttacctaaaaaactacagtgcagtgccttttcccatgccttgtctacaagtcccagtgacaagggacaaagcaaaacacataccataaatgcttatcatttagatcccaggggcccaaaatctgaactggagcatgagttttatgaattagaacctctggcttcccacagctgcactgcccctgagaagaccacttatgaagagacccacatctgctctgaatttttcaacagccaagcaaagaatttagggatgcctgtgcatgcagcttacaacagtgaactcagcaaaagcactgaaagtgacgctggctctgccttgttacagccccctcttgaacagcataccgtgtgtcacttcttctctctgaatcagagatgtagctgccccgatgcctacaaacacttgaactatggcccacactcttgccagcagatgggggactgcttgtgccaccagtgctctcctaccactagcagctttgtccagatccaaaacggcgtggcacctctgaaggccacacaccaagctgtcgagggctttgtgcaccccatcacgcacatccaccactgtccctgcctgcagggcagagtaaagccagccggaatgcagaattctctgcctaggaattttttcctccacccagtgcagcacattcaggcccaagaaaaaattggcaagaccaatgtacacagtcttcagaggagcatagaagagcatcttccaaagatggcagagccatcgtcatttgtctgcagaagcactggatcgttactcaaaacgtgttgcgaccccgagaataaacaaagggaactctgtaaaaatagagacgtgagcaatctggagagcagtggagggactgaaaacgaggcaggagggaaagtggagctgagcttgtcacagacggatgcaagtgtgaactcagaacatttcaatcagaatgaaccaaaagtcctatttaatcatttaatgggggaggctggttgtaggtcttgcccaaataattcacaaagttgtggcagaattgtgagagtgaagtgcaattctgtggactgtcaaatgccaaacatggaagccaatgtgcctgctgtattaacacactcggaactttctggtgaaagtttgttaataaaaacactataataaatgcagcattcaattcag

SEQ ID NO: 1013 - DNA, 3292 bp, Homo sapiens
agccgagcccagcccgggggacccgccgccgccggtcatgtgggccggactgctccttcgggccgcctgtgtcgcgctcctgctgccgggggcaccagcccgaggctacaccgggaggaagccgcccgggcacttcgcggccgagagacgccgactgggcccccacgtctgcctctctgggtttgggagtggctgctgccctggctgggcgccctctatgggtggtgggcactgcaccctgcccctctgctccttcggctgtgggagtggcatctgcatcgctcccaatgtctgctcctgccaggatggagagcaaggggccacctgcccagaaacccatggaccatgtggggagtacggctgtgaccttacctgcaaccatggaggctgtcaggaggtggcccgagtgtgccccgtgggcttctcgatgacggaggcagctgttggcatcaggtgtacagacattgacgaatgtgtaacctcctcctgcgagggccactgtgtgaacacagaaggtgggtttgtgtgcgagtgtgggccgggcatgcagctgtctgccgaccgccacagctgccaagacactgacgaatgcctagggactccctgtcagcagagatgtaaaaacagcattggcagctacaagtgttcctgtcgaactggcttccaccttcatggcaaccggcactcctgtgtagatgtaaacgagtgtcggaggccattggagaggcgagtctgtcaccattcctgccacaacaccgtgggcagcttcctatgcacatgccgacctggcttcaggctccgagctgaccgcgtgtcctgtgaagctttcccgaaagccgtgctggccccatctgccatcctgcaaccccggcaacacccgtccaagatgcttctgttgcttcctgaggccggccggcctgccctgtccccaggacatagccctccttctggggctccagggcccccagccggagtcaggaccacccgcctgccatctcccaccccacgactacccacatcctccccttctgcccctgtgtggctgctgtccaccctgctggccaccccagtgcctactgcctccctgctggggaacctcagacccccctcactccttcagggggaggtgatggggaccccttcctcacccaggggccctgagtccccccgactggcagcagggccctctccctgctggcacctgggagccatgcatgaatcaaggagtcgctggacagagcctgggtgttcccagtgctggtgcgaggacgggaaggtgacctgtgaaaaggtgaggtgtgaagctgcttgttcccacccaattccctccagagatggtgggtgctgcccatcgtgcacaggctgttttcacagtggtgtcgtccgagctgaaggggatgtgttttcacctcccaatgagaactgcaccgtctgtgtctgtctggctggaaacgtgtcctgcatctctcctgagtgtccttctggcccctgtcagacccccccacagacggattgctgtacttgtgttccagtgagatgctatttccacggccggtggtacgcagacggggctgtgttcagtgggggtggtgacgagtgtaccacctgtgtttgccagaatggggaggtggagtgctccttcatgccctgccctgagctggcctgcccccgagaagagtggcggctgggccctgggcagtgttgcttcacctgccaggagcccacaccctcgacaggctgctctcttgacgacaacggggttgagtttccgattggacagatctggtcgcctggtgacccctgtgagttatgcatctgccaggcagatggctcggtgagctgcaagaggacagactgtgtggactcctgccctcacccgatccggatccctggacagtgctgcccagactgttcagcaggctgcacctacacaggcagaatcttctataacaacgagaccttcccgtctgtgctggacccatgtctgagctgcatctgcctgctgggctcagtggcctgttcccccgtggactgccccatcacctgtacctaccctttccaccctgacggggagtgctgccccgtgtgccgagactgcaactacgagggaaggaaggtggcgaatggccaggtgttcaccttggatgatgaaccctgcacccggtgcacgtgccagctgggagaggtgagctgtgagaaggttccctgccagcgggcctgtgccgaccctgccctgcttcctggggactgctgctcttcctgtccagattccctgtctcctctggaagaaaagcaggggctctcccctcacggaaatgtggcattcagcaaagctggtcggagcctgcatggagacactgaggcccctgtcaactgtagctcctgtcctgggcccccgacagcatcaccctcgaggccggtgcttcatctcctccagctccttttaagaacgaacttgatgaaaacacagactttacctacaagcccggcaggagctcatggtccacactcactcgctttggggctgacagccactttcccaggggagcctggggcctcccctcgactctcaccagggccttcgacccctccaggagcccccactctacctctagcttccccaggggctcctcagccacctcctgtgactccagagcgctcgttctcagcctctggggcccagatagtgtccaggtggcctcctctgcctggcaccctcctgacggaagcttcagcactttccatgatggaccccagcccctcgaagacccccatcaccctcctcgggcctcgcgtgctttctcccaccacctctagactctccacagcccttgcagccaccacccaccctggcccccagcagcccccagtgggggcttctcggggggaagagtccaccatgtaaggaggtcactgtgtccgggagactctggagagaggacctctgccagtggcccagggtgtgtgcagggcagctccaaggatgaacctggtggggatgcctgggctccctcctgcaggggccctggtgaggatggaagacccccaaggctggatgtaaccttgttcccaagaagtgtttggaatgtgctgtaagaatggaggaagtcgtttccactgtcagcatcctccctggaccgcgtggctggctcatcttttgagaagggttgggactgccaagttctcctggaggaagagttgcgtccggctgggattccactcactgggactgtaccgccaggtgtcatgcgtctctctgaggtttcctgattaaaggttgtctcggtttccc

SEQ ID NO: 1014 - DNA, 3566 bp, Homo sapiens
agaatcagtgcttactgagcatcctccacaagatagcaaggtatcttagatatggagagatgtagcggggatcctgcagagagtagtgtgggagaggagtgccctcaggcctccctgatgtcagaaccatctgcacaggctaaacagagatcggttcttggaccttgtccctgtatcagagtctcagggcctgagccatgaggattcagcatctccaagatgttcagcctgagtgagttcgcaaacaggagtttgctgacttgaggctcggtgccagcccatctcttggaaagcaagctgccaagctgtgctacagcgcctttgcatggccaccccacaggcttttccagaattctgctccaggagctcagctctttcgacctttcctgggactcaaggcacatcctcagcttctcttcttgagccccccacccaacccctgctctctagcagctctgggggctgcaccagtctctccatggactgacaatagaaacacctgggagaaaatgcccatgaggaagatggactcatcttgaggaagatgcccatgctgcagatgtggagacatgtgagatagatgaggccggcacactccccacatcctggagaaaggcgggaactcaccaaatcccaaccccttagcctttcggatcccgcagtcgggcctgaggtgcagagctgggcttgaggcaggggctttgctaagagctgcaggagggccgaggcccaggaggtgtgtccttgcctgccacgcacattattttgctggtgttactgcattgcccagaggaatgagaattagaaatgtgaatgtgtgcaaagaaacactggggggaagaaagactttggggaaaatcttctcccaactcaaaaaatccccctgaatctctccatttctttctctaaacacaattctttattattttacattgtgcacactattcatgtttactattgaaacattttttaacctatgaatttgtttatttcaccttgtgtcttctattcagtaataagacacttgtagaaatcatgacactattgttcagatactcagatttctcaggtaaattaacattcccatcttgaccaataactcctttgttgcaaacattaaatctacagccaaagacaaatggaaaagtaggaatgaccaacaaggatagactaggaatgagacacccatttatactttatcattatcttaatgctggtactgtacttcacaccccaaaaagttacttgggagcagtctttgttttcagctattttcacttgtctatccataaaagaatggatgtataactagcagatggactttgggactcgctcacatagcatggtggcttcctgctaccgggaagcacaggtggttctgagcactggccacgccccactgagcagcacttaccctgtgtgtccatctctacatatggaagatgagaaaagtaatacccgccccctgggtttgcggtgagcatggatgagatcatgtacgtacagcacttagcaagggtcctgcccccatgaaaactacaatgcatgttgtttctctgggaccagggggcacacagcagaaagtgccttagcctctctgtcaaacgttcttttctggcgatttcatcaaggttgggaacagagagacaaccttcactttggaaggtaatttctccccttttctctatgccttctggctgatccaaggagtagacttccccagggaagtctgacaatctcagtggcttaggaaagtgctcctcctatgtggggttgagaaccaagtggccgaaccaaggagggtgagtggattgcatgagctccccaggacagggtggagctggagggctgtcttcccttcgacagtagcagctttgaagcacatgtgggtactgttagtgcaaatggcatggagcatctggtgaagggcagggtaagatttcaccagctgtcagtgtctaatgtccccaagtctcattttgattgagatagaaaagacatcaaaacctaatctgttaaagcattgatcttaataatagtcgtatttttctatatcatccgtatcggtaagcatttttgtattcatgtgagctaatttgtgagatgatcaaggaatatggaaagaccaggccaccaagcatgaaagtctgattctgtggtttagtatgacacctcagaggttctagcagtccttggagggtcgtccaatcgcccaagtttgacctgggtggcactttagacctggcacgcctcttactctcagtattctgagagtaagctcagaatactctcagcttttgcagccatctgactctctgacctcagagcaaaggggctggagacagagctgggtgaggtgctgggggagagtcatttccactgccctcattacttgaaggatgcaggttgaaaattccctgttggtaattcattagcctgggaaataaataatgtggaaggcacagaggtggcatagaggaaagttgctcaccagtacccaacccccacaccggccataccaaacaggtatgtgggaacccaggtgcggggcacgatttgacaagtgggggtgctctccggccagtgctcgccaggcagcaacaggagcctctggtggagaagcagtgccagcaggatggctggcccacagtgcagaccggcttcctgggaaacaaggcaagtcctggctccaccacatctttggcaagtctctaaccctctttctgtttctgactgctcatgcttttagcacagggtttgacacatagtcgtaagggcaaatactggaacattattgatattattagtctctcagctcctgaaaccatctccagcaatctttctctgcccctgcacatggagtaagggtctgggtgggagaggcaggcacagttctatctggctttccctgaataccttaaagaaactccagcgggggtcaggtctgcgatgctagcgtaattgccgaagttcctctgtctcttcgaacttccctccaggacattccctccgcaagcctttctctcccctttctcaccatctggtttgctttcatacctacacttgccgtgcttctggacgtctgtggcaaccctgctgtgaaggtctcaggtacagaacttagtcttacgtggaagaaaacacagggcttcccaaaggtcttactgcaggtttaaactgtaatggtgttagaagtataaataatacaaacttagaaaaggcaacattgtaaaggataataatttaaacatttaagatactaatatctttgctatggacattcaagataaccgctgtcttgtgctagtggttctagtccattttcaaactgcaaacacggagaagcagccacaggaaggttgcctttgaagatcctccaaagaacatcctgggacggaaggtctgatggagactgccagtgaacaacaaggcctctgccatgctgtgggtctggatgaacatctggacatggtctcacatgcagcctaaaagctgaaatgtaatactcaaatttgcaatgctgaagtaatggggaatatttaaataaacttccaaatgatgagttc

SEQ ID NO: 1015 - DNA, 2320 bp, Homo sapiens
ctcttctcagggctcctcatcttggcctaccccttcctgaaggctcggttcaacctggaccacatcctgcctaccatagggagcctaagaatccatccccatccaggggcagaccacggggaaggaagatccagcaccaatggcaacaaggaaggagcccgcagcagcctgtccaccgtgagcaggaccctggagaagctgaagccggggacccggggggctgaggaatgctgaggcaaagtctgagcggctgcccatgccctgccctcccgtcctgcctgctgcccctatgtcagtgccctcctgggttaggagacccggaccggagacaagccaggccctgcagaccccagagcggctgggaacagtgtctggaatggggccttttgcactcgcccggccaagcctctccaaaatggattccactggtgtgggctgggacttggagcaaggtgccgccggacgcccccacagggttcccatgtttcaggctcctgccctggcctttctttctggactgcagctcagctttgttgcctgttcaatctactgatttgtttctctggaatttggggtccaaggccctgactatgaccaggatgccccagtcccttgctctaacccggctacagaagtgaaccacaggcccacaagaaccacagacagggaccctccacccccacggtctagcccaggggctctagagctcactagcccaatagaggggctagacaagattcttttccaaatatcaaaactcctggcagttcctcagggacaggctctgagcagcagtgaatcagatgggggaatttggggggctcacaaagggacaggtacaaacaacttcgcctgggggtcagaggaggcaacttctcagctgagcccaggcctgagacccttggtgtcttaactccaccactcaaggcttttcgtgatctgacttctctcttcctcccatcttctcactgctccctgaacaagcaaaacacattcctgtctccaagctttgccctgtgttctccagcaccctccctgcttctgtctgcctatcaaacaccccacttttaaagtccccgttcaaaaaatctcctacccacgtggtttcctcattctcttccaccaacctctgtcttgccacctttcaggcagggctgaagtcttccttttcacaaaacaattattaaaccatcttaagtctactgaacgttgcccctgctctagtgtctagcaccagaccagtaggtgcttaataaatgttaatggattcgatttaatgtaaaaacaattccctaggctttccctgggaagccacttcaaagtcccatctaccgtgggtagagcaaggaggcccaggtgtggcctcacagaaaacattgttcctccctccacacctgcaccctccaggcagagttgtttgacctctacagagataccctctccatacggcctctggcctggtttagtgagcagaagacaagctagaaatcatgtccttcttccgggatcaatggagacggcacttcctcttagaagcctcccctgacttcactgtgcttcccagccccagggtttccctccttcacagaccaatctgagtggcctttgtctatttcccctcttgagagtgggagcagagggccaggcacccagacgacaccccagtggatgttggaaaaaccaaagttttctgaagcacagagtccatctcagatgggaaagctgaggccccactggaaaaaggactcatcgagtcccatggtgaaagatcacggggccaggcctgcagccaggtctcctatctctccctatccaaggctctatcttctgctgtcctctgcacaagtggcagggatcagttctctgacaacagtgcgacagacctccatgaaggggctgccttccacaaatgctggctaggtgtagagacttcgtttccttcagctgagagaagcaacttcctctctttgaactgccctcctctccacccagctgctgcctattccctgccccttctcctttccttcattatcatcaacaatatctcaggctgctggtccctcctcaatcaatgaggagacccttcctcctatccatcttcgatcctcacctcagtgccccagagatgccccagggtggagggggtgggaatgggggatgtggagactgagctgtggagagtgtggttccctcccccctgcccatcaacccctctcagccatgctctccccagggtggggctatggaatccccgatgcctggcagggccaggcagagagagatgctggggaccaggtggaataaatcaaggaatgaaagc

SEQ ID NO: 1016 - DNA, 3158 bp, Homo sapiens
ttgctgtcatgtcagacttagaagtcttaatcgtaaaactggagtcaggccctaaaaatggagagagagttcaccaccatccacataagaccaacaatcgaataagacggacagaagaaggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccactttcagcacctgctctatagacgttttgctcctgatatttcgtcctatgtcttgtctgatgacatcaagctacattccctccagctgctacccatttaccagaccggttctcttacatctgatggaaaaaatttgtctcaggaaaaagaattgctgagtctcttttgctttttctccttacctcatgtgggctatctctacatggttgtcaaatctgttgaattgatgtcagtctaccagtatcctgaaaagtctcagcaggcagtactcacgccacaatttttgcacgtcattacaagtaacaacctgcagtgtttcactgtgcggtgcagtgcggcggcagctcgtgaggaggacccgtacatggacaccaccctgaaggcttgcccacctgtcagtatggatgtctgtgctttaagaatacagcttttcataggcttgaaagccatctgtcactttaaaaaccacatcatacttttgactaaagcagaacctgaagccattccggagagaagacagtcacccaagaggcttctttcgagaaaagataccagtgttaaaatcaaaatacctcctgtagctgaggctgggtggaatttgtatattgtgaatacgatctcaccagtgcagctgtacaaagagatggtagactatagcaatacctataagactgtcaaaacccagagctgcattcaccttctcagtgaggctcatctgttagtgcgagctgccctgatggatgccagtcagctggaacctggagagaaggcagagcttttggaagcatttaaggaaagctgtgagcaccttggggactgttacagcaggcttgactcccagcattctcatctcaccttgccatactataagatgtctggtttgtctatggctgaagttctggcccgcacggactggacagtagaggatggattacagaaatacgagagaggattaatcttttacattaatcattcactttatgaaaacctggatgaagaattaaatgaagaattagcagcaaaagtggttcagatgttttatgtggctgagccaaagcaagtgccccatattctctgtagtccttctatgaagaatattaatcctttaactgccatgagctatctaaggaagctggatacttctgggttttcatcgatcttagtgacattgaccaaggcagcagtggctctgaaaatgggagatcttgacatgcacagaaatgaaatgaaaagccattcagagatgaagttggtatgtggcttcattctggaacctcggctgttgattcaacagagaaagggacagattgttccaaccgagcttgcacttcacttgaaggaaactcagcctggattgcttgtggcttcagttctgggcttgcagaagaacaacaaaattggaattgaagaagcagattccttttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatctgataaatgcctgtagtcattatggcttaatttatccatgggttcacgtcgtaatatcatctgattctttagctgataaaaattatacagaagatctttcaaaattacagtctcttatatgtggtccttcatttgacatagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccggactctgtggtggaaaaaactgttgcctgaactttgtcagagaataaaatgtggtggagagaagtatcaactctacctgtcatcattaaaagaaacattgtcaattgttgctgtggaactagaactgaaggatttcatgaatgttctcccagaagatggtactgcaacatttttcttgccatatcttctctattgcagtcgaaagaaaccattgacttaaaggtatcatttgaaaaataccataatggcatttgagactgaatttctaaaaattgaatgccaaagtacaagtagaggagttttttattttatatatcacacacacacacacacacacacacacacacacacatatatgatacaaatgctttcaggctgcttaccttaccgtgtagtggtaactattcacttcttaatttatgacctcaatcaatttaattgtctagaatgtaaaaagtctttaagacataagaattcctcaaagaagccatacattttttaaggtggggattgacttttattccaaggaacaacatcagttcactgttgttggagacatgacaatcattttcatcccaagaacactttaaggaaacattttacaagtatgcttgaaagaatgtcactaactggtccagaattttatcttcttgatttttccagatttctctatgtttttgagaaagatgttaatgttttgccatggtaaaagatttcaaacctcattttttttgttccttttcttgttacttttaagaaaactcatgctctgtttctctgaatcaaatgaagtagaagtttacaaagctaactttcttcttgtctagctattaacatgatttgtcaaatgcatgtttttttcagccaaagccttgtttccatttttgttgatgtgtactcttgctcttttagctagagtgtatgtgaaaataaagaaatacatcattgtattcac

SEQ ID NO: 1017 - DNA, 2177 bp, Homo sapiens
agtctaagcaaaccccagcaggaaagcaggggtacagagaggagcccccttggcaccgccaccgcaccctaggccacccaccatggcgctgggcttggagcaggcggaggagcagcggttgtaccagcagacgctcctgcaagacgggctcaaagacatgctggaccatggcaagttcctcgactgtgtggtgcgggcgggcgagcgcgagttcccgtgccatcgcctggtgctggccgcctgcagcccctacttccgggcgcgctttctagccgagccggagcgcgcgggcgagctgcacctggaggaggtgtccccggacgtggtggcccaggtgctgcactacctgtacacatcagagatcgcgctggatgaggcgagcgtgcaggatttgttcgccgcggcacaccgcttccagatcccttccatcttcaccatctgcgtgtccttcctgcagaagcgcctgtgcctctccaactgcttggccgtcttccgtctcggcctcctgctcgactgcgcgcgtctcgccgtggctgcccgcgacttcatctgcgctcacttcacgctggtggcgcgcgacgctgacttcctcggactctcggccgacgagctcatcgccatcatctccagcgacggccttaacgtggagaaggaggaggcagtgttcgaggcggtgatgcggtgggcgggtagcggcgacgccgaggcgcaggctgagcgccagcgcgcgctgcccaccgtcttcgagagcgtgcgctgccgcttgctgccgcgcgcctttctggaaagccgcgtggagcgccaccctctcgtgcgtgcccagcccgagttgctgcgcaaggtgcagatggtgaaggatgcacacgagggccgcatcaccacgctgcggaagaaaaagaaggggaaggatggagccggggccaaggaggctgataagggcacaagcaaagccaaagcagaggaggatgaggaggccgaacgtatccttcctgggatcctcaatgacaccctgcgcttcggcatgttcctgcaggatctcatcttcatgatcagtgaggagggcgctgtggcctacgatccagcagccaacgagtgctactgtgcttccctctccagccaggtccccaagaaccacgtcagcctggttaccaaggagaaccaggtcttcgtggctggaggcctcttctacaacgaagacaacaaagaggaccccatgagcgcatacttcctgcagtttgaccatctggactcagagtggctggggatgccaccgctgccctcgccccgctgcctctttggcctgggagaagctctcaactccatctacgtggtcggtggcagagagatcaaggacggcgagcgctgcctggactcggtcatgtgctacgacaggctgtcattcaaatggggtcaccgacacagggctgaccagttctgccgaagtgtacagcatcacagacaacaagtgggcacccttcgaggccttcccacaggagcgtagctcactcagcctggtcagcctggtgggtaccctctatgccattggtggctttgccacactggagacggagtctggagagctggttcccacagagctcaatgacatctggaggtataacgaggaggagaagaaatgggagggtgtcctgcgggagatcgcctatgcagcaggtgccaccttcctaccagtgcggctcaatgtgctgcgcctgactaagatgtgaccagctcaggcagactgaactaagcacccctcccatcctgcgaccctcactggcctggccttgtgggggctccagaaaagaggctaggagaggccagagtctacctggatccagttatggtgcctcaggggctgcgtcagccaaggaaagggaagtgctgcttagtcctggacttttgggcaagggtgagaaactagaggcttctccagtgttgccatatccccctaggttgtcttgatccatgaaccagaaccacagggcggtatcccaggccgtgtgctggccctgccccagcctagctgagtgtgctggcaaagttccccacaggactcagccttctcgtctgtccgatgggagcatccccatcaagtgcagtgtacagtgcagatatgtctccttctttaggaagaataaagtgccttctgagcaagcagctcagggtctgcatcagtg

SEQ ID NO: 1018 - DNA, 2714 bp, Homo sapiens
gctgtttctgtgcttaaagccatcttccaggaagtgcatgtacagtccctgccacaggtggaccgacacacagtctacaatatcatcaccaattttatgcgaacccgggaagaagagctaaagagcctaggagctgacttcacctttggcttcatccaggtgatggatggggaaaaggatccccgtaatcttctggtggccttccgcatcgtccatgacctcatctccagggactatagcctgggaccctttgtggaggagttgtttgaagtgacatcctgttatttccctatcgattttacccctccacctaatgatccccatggtatccagagagaagacctcatcctgagtcttcgcgctgtgctggcttctacaccacgatttgctgagtttctgctgcccctgttgattgagaaagtggattctgaggttctgagtgccaagttggattctctacagactctgaatgcttgctgtgctgtgtatggacagaaggaactgaaggacttcctccccagcctttgggcttctatccgcagagagactgcaggcaccacctgtgtgaaccggacatgaaactggtgtggcctagtgccaagctgttgcaggcagctgcaggtgcatctgcccgggcctgtgactctgtcaccagcaatgtactgcctttactgctggaacagttccacaagcacagtcagagcagccagcggcggacaatccttgaaatgctcctgggtttcttgaagctgcagcagaaatggagctatgaagacaaagatcaaaggcctctgaatggcttcaaggaccagctgtgctcactggtattcatggctctaacagaccccagcacccagcttcagcttgttggcatccgtacactgacagtcttgggtgcccagccagatctcctatcttatgaggacttggagctggcagtgggtcacctgtacagactgagcttcctgaaggaggattcccagagttgcagggtggcagcactggaagcatcaggaaccctggctgctctctaccctgtggccttcagcagccacctcgtacccaagctcgctgaggagctgcgtgtaggggagtcaaatttgactaacggagatgagcccacccaatgctcccggcatctgtgctgtctgcaagccttgtcagctgtatcaacacatcccagcatcgtcaaggagacactgcctctgctgctgcagcatctctggcaagtgaacagagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccagagaaggagccctcagttctgagaaaagtactattggaggatgaggtgttggctgccatggtgtctgtcattggcactgctacaacccacctgagccctgagttagctgcccagagtgtgacacacattgtgcccctcttcttggatggcaacgtgtcctttctgcctgaaaacagcttcccgagcagattccagccattccaggtaacagatggctcctcagggcagaggcggctgattgcactgcttatggcctttgtctgctccctgcctcgaaatggcagcagctggatgaattcctacagctagctgtggacaaagtggaggctggcctgggctctgggccctgtcgtagtcaggccttcactcttcttctctgggtaacaaaggccctagtgctcagataccatcctctcagctcctgccttacagcccggctcatgggcctcctgagtgacccagaattaggtccagcagcagctgatggcttctctctgctcatgtctgactgcactgatgtgctgactcgtgctggccatgctgaagtgcggatcatgttccgccagcggttcttcacagataatgtgcctgctttggtccagggcttccatgctgctccccaagatgtgaagccaaactacttgaagggtcttcctcatgtacttaacaggctgcccaagcctgtactcttgccagagctgcccacgcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagccaaacccctggatgacaagaagagactggtgcgcaaggaagcagtgtcagccagaggggagtggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggt

SEQ ID NO: 1019 - DNA, 2710 bp, Homo sapiens
aagaaaaatgtctcgaagtcaagggcatacaagagaaacaagtcttctctaatactaaagattcaaagcaagagattacacagaacaaatctttcttttcctctgtgaaagaatcccagcgggatgatggaaaaggtgccttaaatatagtggaattcttgagaaaacgtgaagaactgcaacagattttgtcgagagtgaaacagtttgaagcagagccaaataaaagtggccttaaaacatttcagacactattaaatactatcccaggatggctgataagtgaagataagagagaatatgcagttcacattgccatggagaataatttagaaaaagtaaaagaagaaataacacatattaaaactcaagcggaagatatgcttgtgtcctatgaaaatataattcagacagccatgatgtcctccaaaacaggaaaaccgggaaataaacccactagtcttgatgaaacatcatccaaagtatctaatgttcatgtcagcaataataaaaatagtgaacagaaagaaaataaaattgccaaagagaaaacagtacagcaccaagtagcagctcatcatgaagcaactgttcgtagtcacgtgaaaacccatcaggaaattaaacttgatgatagcaacattcctcctccctctttaaaaacacgcccaccgtcaccaacttttatcacaatagaatctactgcccgacgaacagaaaaccctactaagaacgagctttctcagtcccctaaaaaggacagttatgttgaacccccaccaagaaggcccatgtcgcaaaaatctgaaattcacagagcaaacacttccccttctccacccaggagtcgctctgaacaacttgtcagactcaaagacaccactgcaaagttatccaaaggggccatcccatgtccagcagcaaccccggttccaattgtagagaagaggtctgaaatcatcatgtctcctgcaacacttcgtcgtcaaattaagatagaaactcgtggtagggactctccacctacaatcacaataccagtaaatataaatcatgctgctagtggttccttcagagaatctgtggacgctcaagaggaaatcaggaaagtggagaagagagctacttatgttcataaagatggactaaattccactgatcacatggtgcccgacactgaaagttatgatgcagttgaaatcatccgcaaggttgcagtgcctcctcgcctgtcagagcacacacagagatatgaagcggccaaccgaactgttcaaatggctgaaaatttcgtgaatgaccctgaaaatgaaataaacagatggttcagggaatttgagcatggcccagtttctgaagcaaagtcaaatagaagagtttatgcaaagggagaaacaaaccataacatacaacaagaaagtcgtacattttgtaaggaggaatttggattaacatctttaggaaacacgagttttacagacttttcttgcaaacatcctagagaactgcgagaaaagattcctgttaagcagcccaggatctgctctgaaaccaggtctctaagtgaacatttctcaggcatggatgcatttgagagtcaaattgttgagtcgaagatgaaaacctcttcatcacatagctcagaagctggcaaatctggctgtgacttcaagcttgccccaccaacctatgaggatgtcattgctggacatattttagatatctctgattcacctaaagaagtaagaaaaaattttcaaaagacgtggcaagagagtggaagagtttttaaaggcctgggatatgcaaccgcagatgcttctgcaactgagatgagaaccaccttccaagaggaatctgcatttataagtgaagctgctgctccaagacaaggaaatatgtatactttgtcaaaagacagtttatccaatggagtgcctagtggcagacaagcagaattttcataagtcctgcttccgatgccaccattgcaacagtaaactaagtttgggaaattatgcatcacttcatggacaaatatactgtaaacctcactttaaacaacttttcaaatccaaaggaaattatgatgaaggttttggacataagcagcataaagatagatggaactgcaaaaaccaaagcagatcagtggactttattcctaatgaagaaccaaatatgtgtaaaaatattgcagaaaacacccttgtacctggagatcgtaatgaacatttagatgctggtaacagtgaagggcaaaggaatgatttgagaaaattaggggaaaggggaaaattaaaagtcatttggcctccttccaaggagatccctaagaaaaccttaccctttgaggaagagctcaaaatgagtaaacctaagtggccacctgaaatgacaaccctgctatcccctgaatttaaaagtgaatctctgctagaagatgttagaactccagaaaataaaggacaaagacaagatcactttccatttttgcagccttatctacagtccacccatgtttgtcagaaagaggatgttataggaatcaaagaaatgaaaatgcctgaaggaagaaaagatgaaaagaaggaaggaaggaagaatgtgcaagataggccgagtgaagctgaagacacaaagagtaacaggaaaagtgctatggatcttaatgacaacaataatgtgattgtgcagagtgctgaaaagg

SEQ ID NO: 1020 - DNA, 2577 bp, Homo sapiens
gacggaagccacactgctgcagaagctcaccacccagtgcctgaccaagcaggtggccctgcagagccagttcaatacctacaggctcaccctgcaggacacagaggatgccctcagccaggaccagctggtgaggccgggcccgccccacaggtcacacctggcgcacggtggtgcctcttcaggcacgtgcaccctgtggctccttgtctccaggaacaaatgatactcacggaggagttgcaggccatccgccaagccatccagggcgagctggagctcaggaggaagacggatgcggccatccgggagaagctgcaggagcacatgacctccaacaagaccaccaaatacttcaaccagctcatcctgaggctgcagaaggagaagaccaacatgatgacacatctttccaaaatcaacggtgacattgcccagaccaccctggacatcacacacaccagcagcaggctggacgcacaccagaagaccctggtggagctggaccaggacgtgaagaaagtcaacgagctcatcaccaacagccagagcgagatctcccggcgcacgatcctgatcgagaggaagcaagggctcatcaacttcctcaacaagcagctggagcggatggtctccgagctggggggggaagaagtggggcccctggagcttgaaatcaaaaggctgagcaagctgatcgacgagcacgatggcaaggcggtccaggcccaggtgacctggctgcgcctgcagcaggagatggtcaaggtgacacaggagcaggaggagcagctggcctccctggacgcatccaagaaggagctccacatcatggagcagaagaaactacgagtagaaagcaagattgagcaggagaagaaggagcagaaggagatcgagcaccacatgaaggacctggacaacgacctgaagaagctcaacatgttgatgaataaaaaccggtgcagctcggaggagctggagcagaacaaccgggtgacagagaatgagttcgtgcgctcgctgaaggcctctgagagggagaccatcaagatgcaggacaagctgaaccagctcagcgaggagaaggcgaccctcctgaatcaactggtggaagcagaacaccagattatgctttgggagaaaaaaatccaactggcaaaagagatgcgttcctcagtggattccgagatcggccagacggagatccgggccatgaagggcgagatccacaggatgaaggtcaggctcgggcagctgctgaagcagcaggagaagatgatccgtgccatggagttggcggttgcccgcagagagaccgtcaccacccaggccgaggggcagcgcaagatggacaggaaggcgctcacccgcaccgacttccaccacaagcagcttgagctgcgccggaaaatcagggacgttcgcaaggccaccgacgagtgcaccaaaaccgtcctggaactggaagaaacacaaagaaatgtgagcagctccctcctagagaagcaggaaaagctgtcggtgattcaggcagacttcgacacactcgaggccgacctcacccggcttggggccctcaaacgacagaacctttcagagatcgtggccctgcagacacgccttaagcacctgcaggctgtgaaggaggggcgctacgtgttcctgttccgctccaagcagtccctagtgctggagcgccagcgcctggacaagcgactggctctcatcgccaccatcctggaccgcgtgcgggacgagtacccccagttccaggaggccctgcacaaggtcagccagatgatcgccaacaagctcgagtcaccagggccctcctagggagcagcctggactccgccttgcaaggcctccaggaagagatccggaattgtgtttgtcatgagggacttggaatcttttgtgttcctaaaaaccacatgtaccctcagaagggcatcgtttaagagaaataagccagccccacccataggaatctttttagccactcagcaatttaataaaccaggtaaaatcctagcgtttcccatggcatcccaaatctgcacgtgcctctcacaacacaacgctgccacaggtccacaagctggtgggctgagcagaggtgggaaagttaaggcagctccagccagcctggcccgggaggctggtccccccagcacttccctctactaggtgcatctgaaaacccacaaaccaccttctttaccagttttcccatccacaccccttagaactctcaggtcccttttcctgcccccatgtccccatttgagttaaattcagatccacagcttgcaggagaaagtcagtggccccagacacacgtaacagggtgagcactgaaataagagcacgctggggcgtccacaccaagggactacgccccagtctgcccacctatcttctctccatcattaacccagcgctctttctccctggacttccaagtaccaatgaccttggggcttctttgcagtttaaagggaaaatgctctacaaaataatttcactttcaaacatttcagcagaagaataaaatcttttttctgaatatct

SEQ ID NO: 1021 - DNA, 2608 bp, Homo sapiens
agacctcccgcaccagggctctggtgaacagcaaatgctccacgctgggacgggccattgcctgatgcctgtacatggtgggcactgagagacaagattcctgggccctgccttccatacactccccacgatcttggaggaagctctgaggaccccgctgagaacccacagacaggaggacaactgcgctatgacagcaataaaggccaagaaggagaaagttgaggaccgctgacagccccgtgtgctgttgggagctgccctttctacttcaaaccttcctctagcagactgtgcagggaccccccaccaccaccatctgccgccatggttgtgcaaaacagcgcagacgccggggacatgagggcaggcgtgcagctggagcccttcctgcaccaggtcggggggcacatgagcgtgatgaagtatgacgagcatacggtgtgcaagcccctcgtctcccgggagcagaggttctatgaatccctgccgctggccatgaagcggttcaccccacagtacaaaggtaccgtcacagtgcacctctggaaagacagcacaggccatctcagcttggttgccaacccagtgaaggagagccaggagcccttcaaggtctccacagagtcggcggcggtggccatatggcagacgctccagcagaccaccggcagcaatggcagcgactgacccttgccagtggccgcatgcccagctggcacgctcacccaaggagagcccggccaaggctcttctgaggtccgagccccacctcaacactccagccttctcgctggtggaagacaccaacggaaaccaggttgagaggaagagcttcaacccgtggggcctgcaatgccaccaggcccacctgacccgcctgtgctccgagtacccagagaacaagcggcatcggttcttgttgctggaaaatgtagtgtcacagtacacgcatccctgtgtcctggatctgaagatggggacccggcagcacggcgatgatgcatcggaggagaagaaggcccgccacatgaggaagtgtgcgcagagcacctcagcctgcctgggtgtgcgcatctgcggcatgcaggtttatcaaacagataagaagtactttctctgcaaagacaagtactatggaagaaaactctcagtggaggggttcagacaagccctctatcagttcctacataatggaagccacctccggagggagctcctggagcccatcctgctccagctccgggccctcctctccatcattaggagccagagttcataccgcttctattccagctctctccttgtcatctatgatgggcaggaaccaccagaaagagccccaggcagcccgcatcctcacgaggctccccaggcagcccacggtagctctcccggtggtctcaccaaggttgacatccgcatgattgactttgctcataccacatacaagggctactggaatgagcacaccacctacgatggaccagaccctggctatatttttggcctggaaaacctcatcaggatcctgcaggatatccaagagggagaatgaaacttcctgggcttatctggattcttctgggctatagatctcaaatagagacctgttggttgctagggtagtccagacaccccttagatgtcttcataatagtcctatctaccttcaaaaaccatctctatatatggcagactatattaacagctgctgaacaaatcagctctggaggtgattccacatcccctggcattatgctctaatgctgcttatcggagaacagacagccaggataaagtggcaccttctggagtacactggagggggcagcccaagttagaggccagcattgctgacattctggaatatttgcatctaaaaatgtttactcgttgccatgctgcagtccgcacaagctgtgaggcagaaaacttgacttgaagcagccttgaagagtgagttcatgagctcatggtttttctccttgtatggactgctcgctccaagggcaggcagagctcatgaatgcctcttatcttcctaagcggagttttaggtgacacaggatgaagcagaagagatctacccatctcacctgctctgcacccagcttctaagtggacaaagccaagcccaggcatgagctctggcaaagcaagaccccagattctccatttttgcctgtggaaaggagggtccctttacaggcttttttttcctttttttcccccaaaatctcttaaaatgaggaatctcttagcagactttggagttccccattctgccacattctgaccatgagacacggcttgcagtgggggtgaacgcacataaaaagggaccactgacgtcctgctctactctctgctttctatttatttattttgggggtgggttggggagtcagaagaacctggaggacggaggaaaccaggggcaatgtttacaagactggtggacaagtgtaaatatggaataagaacaaacagttctaattaattccttcttctgcagtacggaaacctattacaatgcccttgagtcaagcactgagatacgttacccaattagggaaataaatttgttaataaaattgctgaggtc

SEQ ID NO: 1022 - DNA, 2556 bp, Homo sapiens
cttggcagtcaccatgagggcgctggtcctgctcggctgcctcctggcctcgctcctgttctcaggacaagcagaagagacggaggatgcaaatgaagaagccccattgagggaccgctcccacatcgagaagaccctcatgctgaatgaggacaagccatccgatgactactctgcggtgctgcagcggcttcggaagatctaccactcatccatcaagcctctggagcagtcctacaagtacaatgagctccggcagcatgagatcacagatggagagattacctccaagcccatggtactgttcctgggaccgtggagtgttggtaaatctaccatgataaactacctccttgggctggaaaatactcgctatcagctctatacaggcgctgaacccaccacctctgagttcacggtcctcatgcatgggcctaagctgaaaaccatcgagggcatcgtcatggctgctgacagcgcccgctccttctcaccccttgagaagtttggccagaatttcctagagaagctgattggcattgaggttccccacaaacttctggagagggtcacttttgtggatacaccaggcatcatcgagaaccgcaagcagcaagaaagaggctaccccttcaacgacgtgtgccagtggttcatcgacagagctgacctcatctttgtcgtctttgacccaacaaagctggatgtgggtctagagctggagatgctcttccgccagttgaaggggcgtgaatcccagataaggatcatcctgaacaaggctgacaatctggccacccaaatgctcatgcgggtttacggggccctcttctggagcttggcccctctcatcaatgtcacagagcccccaagggtttacgtcagctccttctggccacaagagtataagccggacacccatcaggaactgttcctccaagaagagatctccctcctagaagacctgaatcaggtgatcgagaacagactggagaacaagattgccttcatccgccagcacgccatccgggtccgcatccacgccctcctggttgaccgctacctgcagacttacaaggacaaaatgaccttcttcagtgatggagaactggtctttaaggacattgtggaagatcccgataaattctacatcttcaagaccatcctggcaaagaccaatgtcagcaaatttgaccttcccgcctgaccttgatgcagatgtccactgaacacaccgcaggaaagccagggccttcaataccaataagtgtgaatatgtgtgtatgttgtccaagagagattagggagatcacatagactctagggagtagagaacttgtaacagtcttgcaaggctagcatgcacggctccacagcaggtggtggggagcagaggggcaggacctgcagggaagaagcagcctttggatggtgaaatgtgcatggtgcacagtctgtgcatgcccaggagacccagcccgggctgcctcgaggggctcctttgtacacagccagccgcttctcttgggaacaagctgtcctgggggccttacccacgaggcaggagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcagaattgttatcactctggtgcatgctgtcacaggggccgttgcgtttggctttgtggagggcctggacccttccacaagaacacccgaggttccagggcactcaggacaatgtttccaaggaacgagtcgaccaggaaagaacagtgagttctgcaaggggcatccacggagcctgtgataggggctgatgagatggaatctgtcctggacttttcttctcattaaccaccctccgcaaaccccagaacccctcgcctcatctctgtactgtctgccctcttgggggatgggccctcccactttcccctgcctgctcctccatgctgtgagctgctttggcagatctgtttttctgtgtagtcaggggaaaaacaaaaaaaaatgcacaactgtgtgggcattgtcatagctgttggtgtcaccactgctttgggggaaatggctgggatgaggctaatacattcatgcaatatttatattttcagggggctgcgttatcagcatgctctccctgccttgggcttttctttccgtcatgttttccttttcgtgttccttctctgatttctcttgtctctgctgctcacaggcctgcccatcagtcagtacagatactcagtgtctggtttctggccagctccgtggagggggctttaagcagaattctgactctttggggtgggggattaggaactgggggaaacttaatgatccagagattcccccaagaggagtgtctggaaggatctgtgcctggacagtggcagaacctttccagtgttcttttggttctgatttcatcagtctcaataaagttccgatctctcttt

SEQ ID NO: 1023 - DNA, 2344 bp, Homo sapiens
tttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggaggacgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcaccaggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgactttgacactgaggctggagctgtgtcctcctcagagcccactgtggccagagatgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcacc

SEQ ID NO: 1024 - DNA, 3085 bp, Homo sapiens
aagtcagcaccgacccaaacaagcaggaaacaggaaatgttcacgtttcagagaggctgcagcccggcgcagcatcctgagcgcgcctctgccgaggcgagcggacatgcaggctccccgcgcagccctagtcttcgccctggtgatcgcgctcgttcccgtcggccggggtaattatgaggaattagaaaactcaggagatacaactgtggaatctgaaagaccaaataaagtgactattccaagcacatttgctgcagtgaccatcaaagaaacattaaatgcaaatataaattctaccaactttgctccggatgaaaatcagttagagtttatactgatggtgttaatcccattgattttattggtcctcttacttttatccgtggtattccttgcaacatactataaaagaaaaagaactaaacaagaaccttctagccaaggatctcagagtgctttacagacatatgaactgggaagtgaaaacgtgaaagtccctatttttgaggaagatacaccctctgttatggaaattgaaatggaagagcttgataaatggatgaacagcatgaatagaaatgccgactttgaatgtttacctaccttgaaggaagagaaggaatcaaatcacaacccaagtgacagtgaatcctaaacctgaatggcgctcatgttttccaagagaagcagcccctgagggagtctgctgaggctgccaacagaggatgaagaggatacaaatttaattaatttcaaatcaacatagacacaagaaccttttgctgtttcttccaacgcccactcttcctaatgatggcatcacttgcacttggaagaatgtgcaattgagaagtactaggaaaaggcctggctgccatccatcgctgcctctgagggtggagaaggaggcgggtgatgtgctcacttctgatcaacatgtgttgcctcctctcagccaacttctagctcactgcactcactctggtcatgataaatgttcgtcacctttctgcttcattccttagggcctaaatcaggaagctgttttatcgatggtttccttttgggtcagtaaccagctttggataatttcctctgattattcaagtcgtgggacaggtaaactacattcagcaggaacttttctcgaggagtgttatgtcatggaaaagacaccaaacacagcaagtattttaatgaatacaccatcccagggggtcagtaagctctgcctgccaagaagacacagtgagaggggtccacagtcctgatgaggtggcgtttggtaacttgtagaccctagcatggccaggtctggtcacccttaagaacttctcagagaaactaggaatcttcagtgaaagaactaatgttctcctcagctgaaattcccttgcttgtcagcatttctgcaaagctcacacttgtttcaccatacctcccttggatgtgacatgtaggtaggaagtatgtgcaggtgggagtcatctgtcagccttctatgtttcagagatcctgaaggtggtttgaaacaaacagaagaggagcaggaaatatccgtgcctgtggcagatctcactcatcatgcttagcattctctcccgccaagctgggataagcctcatgtcctaacacagcacaacaggaggtctctgtcagtccatcagagatgacattctatgtgatatttttgacatccttgtgctaaaagcaatggcacaaaatggaaaagggcctattgaccacacctactccagtaaaattgttcttcatttattccttaattttctaaatctgacccctttaaagcaatctagcaaattgagaatcctcagctctccttggatacctgatattttatttcaagaaagagacaaagaaggaaaattttatttattttactacccacatataaaccgaagggagatgggactacccaaacatttgctgctcaattttgtgtcttgtgcttgaaagtctgccctaatgcataacaaaaactacttgtctcctaccttttgggatccctttaacaagtatttgccttctgaactacgtggataatttcaaaggcagagttccagaccagagaggtctttccatacaatgaaagctataactagctggttgtgtttaaccactgctatcacgctatcctgggactgcatagaactttgacaaaagacagacttcatggtacacaacttcaacagattttctgtcatattctcaccagcacatctgaatgaggctttgtgttttccttgctctcttgcatgttccttttcaactcatggcccacagtgactctcagagatttatgccaaaattgcatacaattgttttctgaatcataacttgtctatttttctgcctatgtgtgctactttcagtttgtttctcatcaacattttgactctcagaagagcctccatttgcccctttctctctttaggtatctaagatctttgaacacctggacctttacatttgatccaaccctatcaaataatgaacttctcagagaggcatctggggtcctggaacttcatgttgatgaagtcatattatataatatgataaaaatattctcatgcagtattttaaataatttcaaattctagaagaagcaaatttcagcgacatgtcattgagtttttatttggtaaagctataattgtgcagtgtacaaagcactttttaaaaagatagtttattctgtcagggtatatgaagttagtatacagccagaacagccaagcctcaattcttgtaccttgtgtctttttattactgtttaatcaatagatatcatatgtttatgacagtttcaagaattgtttttaaacccaaacttaattttatgtttcagactattgttagaaaaacaaaacaaaaaacaaaaaaaccctcactaatttgccctaattggatagggcaatcaggacaaaatctgactttcgaatatttaaaagatatgtaagtttgattgcattttcgtacattttaagcaaactaggttaacaacaacatagcctagtcaaacttctcaggaaacttgttttaataaatatgtaaaaat

SEQ ID NO: 1025 - DNA, 2496 bp, Homo sapiens
gttgttctctcgcggcgcgaccgcctcagtcacttcgcccagagacccggacctggtccgctggggagcaggcggccataaaccccctctctcccggttccctgacgccgcggcaggagctgttacaaacaccctgcggttggtctccgatgcccttcagtgaggtggggacgcctggaccctggtgagcgaaccccaagccaccccccaccccaactcagtgtcttcgccggcccccggcccgtacgcctgtctggtcgccatggctgaaaacacagagggggatctgaactccaacctgctccacgccccctaccacaccggggaccctcagctggacacggccatcgggcagtggctccgctgggataagaatcccaaaacaaaagagcagattgaaaacctgttacggaatgggatgaacaaggagctgcgagatcgtctttgttgccgaatgacttttggggctgcaggacttcgttctgccatgggggcagggttttgctatattaatgaccttacagtaatacagtcaacacaggggatgtacaaataccttgagagatgtttctcagacttcaagcagagaggctttgtggttgggtatgacactcggggtcaagtaactagcagctgcagcagccagaggcttgctaaactcactgctgcagtcttgctggccaaagatgttcctgtgtaccttttttcaagatatgttcctacaccttttgtaccatatgcagttcagaagctcaaagcagttgcaggtgtgatgattactgcctctcacaaccgcaaggaagacaatggatacaaggtttactgggaaactggtgctcagatcacatctcctcatgataaagaaattctaaaatgtatagaagaatgtgtggaaccctggaatggttcctggaatgataatttagtggataccagcccgctgaagagagaccctctgcaggacatttgcaggagatacatggaagatctgaaaaagatctgtttttacagggagttaaactcgaagaccaccttgaaatttgtgcacacatcttttcatggggtcggacatgactatgtgcagttggcttttaaagtgtttggttttaagcctccaattccagtaccagaacaaaaagatcctgatccagacttttctaccgttaaatgtccaaatcctgaagaaggagaatctgtgctggaactttccttgagactggcagagaaagaaaatgcccgggtagtgctagccacagatcctgatgcagacagactggcagcagcagaacttcaggagaatggttgttggaaagttttcacagggaatgagttggcagctttgtttggatggtggatgtttgattgctggaagaaaaataaatcaagaaatgctgatgtgaagaacgtttatatgttagccaccacagtctcttctaaaattctgaaggcaattgcacttaaagaaggatttcattttgaagaaacattaccaggttttaaatggattggaagtaggataatagacctcctggaaaatgggaaagaagtcctttttgcatttgaagagtctattggttttctctgtggaacttcagttttggataaagatggggtgagtgcagctgttgtggttgctgagatggcatcttacctggaaaccatgaatataacattgaaacagcaactggttaaggtttatgaaaaatatggttatcatatttcaaaaacttcctatttcttgtgttatgaaccacctaccatcaaaagtatatttgaaaggcttcgtaattttgattctccaaaagaatatccaaaattttgtggaacatttgctatattgcatgtacgggacattaccactggatatgacagtagccagcctaataagaaatcagtgctgcctgtgagtaaaaacagccaaatgattacatttacttttcaaaatggctgtgttgctacccttcggacaagtggaacagaaccaaagataaagtattatgcagagatgtgtgcgtcacctgaccagagtgacactgctttactggaggaagaactgaagaaactcattgatgctctgatagagaattttcttcagcctagtaagaatggactgatctggcgttctgtttaggggtacaccaatatgtcatgacactgtgtgggcatatggaacagagcaaccgagaactgcatacattgaaccttgtgttagcattctctctctatctcatctggccgagtatctttttccttttattttctttctttttggtcaactggctagactaaacaaagtataagtttgaaatgaaatggtctagagggaaatgattcaaattttttcataattcaaacaaaagttattacactaaaagtattatagtaacgtattgtccttccgttaacagaaacatcacaattcaaaagtgagttttcttattatagtgtgattaagcctagttctgtatctcgtaattgtgtatagcatggtaaaag

SEQ ID NO: 1026 - DNA, 3762 bp, Homo sapiens
agacacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccattggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccaactccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacagggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccag

SEQ ID NO: 1027 - DNA, 2263 bp, Homo sapiens
ggagagaaaccctatcagtgtagtctctgtgggaaagccttccagcgcagctcctcccttgttcaacaccagcgaattcacactggagagaaaccctatcgatgtaatctatgtgggaggtcctttaggcatggcacatccctcactcaacacgaggtcacacacagtggagagaagcccttccagtgtaaggaatgtgggaaagcctttagtcgatgttcttcccttgtccaacatgagaggactcatactggagagaaaccttttgaatgtagcatatgtgggagggcttttggtcagagcccatccctttataaacatatgaggattcataagagaggcaaaccttaccaaagcagtaactacagcatagatttcaagcacagcacatctctcactcaggatgaaagcactcttaccgaagtgaaatcctaccattgtaatgactgtggggaagactttagtcacattacagactttactgaccatcagaggatccatactgcagagaacccctatgattgtgagcaggcttttagtcagcaagctatttctcatcctggagagaaaccctatcaatgtaatgtatgtgggaaagctttcaaaaggagtacaagtttcatagagcatcacagaattcatactggagagaaaccctatgaatgtaatgagtgtggagaagcctttagtcgacgctcatcgcttactcaacatgagagaacccacactggagagaaaccctatgaatgtattgactgtgggaaagcctttagtcaaagttcatctctcattcagcatgagagaactcatactggagagaagccctatgaatgtaatgaatgtgggagagccttccgaaaaaaaaccaacctgcatgatcatcagagaattcatactggagaaaaaccctattcttgtaaggaatgtgggaaaaacttcagccgaagttcagctcttactaaacaccagagaattcatactcgaaataaactctaggaaccgtgaaattaaggaatttgcagaatgctttagctaaaatgttctgattcaggatcagaggattcttagagagcttgggaatgtaatgaattacgtgtgtttatacgttgtgtgtggagaaaactgccagtagacagatttttttttttttttttaacataaagacacattctcagatctgattacagactagtgtaaaaacagctacatgtatgtagctggttggggatgatatgcctgtatgttggactttgcttttgaatatatgtatgcaggatatcatcaagtttcaacatcttgacttgtgacccccaatgtcaacagcttttttaaaaaacaaattcctgcagtaatgaccaaaacccattttaaaaattgcttgacaaccgcactcaactgcagctcttacattaacttcaccatggaaaccagttccaactccaggaagtcaccattcaaagaattagatcaactagcccaaccacttcattgtacagatgaagactgaaagccaaagatgtgaagtggtttccacagtatgatacagcctataagggtaaagctgggttaaaaatgcaggtttcctggatttggggccccatggccttgccagtgaaaaggttatttttggactcagagggctttaaaataaattttaagatgtatcagatacacaaacatttaatgggcacctatgggttggacactttgagaattcttaaaagtataagtgggagcaaaatgtatgcaaatttatcacaaactatttaaagcaacttcttggaggcttacaaaccacaatttaacagaaactgtagatggttgaactactagtgacttttttccccttttcccagttacaattatactttcagctaacatatgccagtttcacagaactattaagtccccttattgtactttttatggcatgcccatgaaaaagcactttcttaagcctacagtatcagatcaatgggaaaacaacagaaaactaagaggagaattttcccgttaattttcttgcagaaaagtataagtctaattgcccattgccataaattttgtcttgtactcagagaagcaacatgcactggctcattttatgtgcaaagaaaagatttcaccattaaaaaaattaacttggctaggtatggtgtctcacacctgtaatcccagcactttgggtggctaaggcagatagactgcttgaacccaggagttcaagaccagcctggacaacatggtgaaaccccatctcttt

SEQ ID NO: 1028 - DNA, 2114 bp, Homo sapiens
atgaagttggagacaaatgtcaagttaggttggatcacaatggaaaatttttgaatgcagatgttcaaggaattcattctgagaatggaccagttttggttgaagaactgggaaagaagcacacatcaaagaacctcaaggcacctcccccagaaagctggaacacagtgtcagggaagaagatgaaaaaaccttccacttctggacaaaatttccattctgatgtggattacagagggccaaagaatccaagcaagccaataaaagccccatcagcactacctcctcgactgcagcatccttcaggagtaagacaacatgcgttctctagtcattcttcagggtcacagtctcagaaattctccagtgagcacaaaaatcttagccggacaccttcacagatcataagaaaacctgatcgtgaaagagttgaggattttgatcacacaagtcgagaatctaactatttcggcctttccccagaagagcgcagagagaagcaagctatagaagaatcccgtttactctatgagattcagaacagagatgaacaggctttcccagccctttccagctcatcagtcaatcagtcagcttctcagagtagcaatccatgtgtccagagaaaatcatcacatgtaggtgatagaaaaggaagcaggcggagaatggatacagaagaacgaaaagacaaagactctattcatggacatagtcagttggataaaagacccgaaccaagcacattggagaatattactgatgataaatatgcaacagtttcatcaccatcaaagtcaaagaagttagagtgcccttctcctgcggaacaaaagccagcagaacatgtgtctttgtcaaatccagctccccttctagtttctccagaggtacatctaactcctgcggtgccttctttaccagccactgtgccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgtgtcagactggggaggacctacctaaagataagaatattcttcgattcttcttcaatcttggtgtgaaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgccttaccaggctgatcttgaatctgagacccctgggcagcttctgcatgctgattatgaagagtcactaagtggcaagaatatgttcccccagccatcttttggacccaatccattcttaggcccagttcctattgcacctcctttctttcctcatgtttggtatgggtacccttttcagggattcatagaaaatccagtaatgaggcagaatattgtcctgccctctgatgaaaaaggagaattggatctgtctctggaaaatctggatctgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctg

SEQ ID NO: 1029 - DNA, 2213 bp, Homo sapiens
aggaatgtgatatgcgacatacacttagcacacgctggttcctttctcttccttctgtaagtcagcactgaccttcagtccctgtgctgacatccctacccctgcctcactgcctatttgaggaactttcctactcagtggtgccttattgaaatggagcatattcctgccacccataggttggagcacccacccctgctggacaagacccttcctgggggggccaccttggaactctgaatagagacttgaagagtgaggaagactaagaggctgctgccatttgaagatgaagtgtacaatacaacagggaatcaagtgaacagaaagtgttgatggggatcccagcagatagccaacaaaagggaacctcacttctacagcagcaaggaactgcattctgccaaaaacctaatgaacttggaagcagattattttctggagtctgtagagagatgagcaggaagagggatattagaagagagaaagtgaaaactggactgaaacattgctagctggggatcttagcctctctttaggcaactcactcctggtcctgttctctgcacatgtgggaattataatgagcaccaagcagaatgaatgaaaataaatccagaccaagaaccactgaagaaactgcaacccacaagagaaaactagccagagtatctgcacaggaaggacaaggagacttctctttataataacagaacccagaagacaacctacaaggttctgcccacaggggagattgtgacctattgctggccccaacaccaagtcgaagttacacatttgccttggccttgccctgagaaggtgctgtgacatattgctgggcccagcaccaaggtgatgggactctcctctttctcctggaacctgtccacagtggggattgtgacatattgctgggcccagcaccactgtgatgtgactctcctctcgtgcctggggccagcccactggggtaattgtgacatataactggacctagcccctaggttatgtgacttacctctccttcctgagccctgcccacaagggggcctcatgacatatctctggacccctcacctaggtgatgtgagtctcttgcctgggcccacccctcagggtgtatagtgacatattgctggacccaacacctaggtgatgtgactcttttctactgcttggctctgcccaaggagaaattgtgatgtatcactgggccgagcacctaggtgatgtgactctcctctcctgcctggctccagccaaaaggggggattgtgacatatcactggacccaacacctaggtgatgggactctcctcttttgcctgggcccacatattttgggtattgtgacctgggtgatgggagcctactgcttgaaccctacccagagggagctttgtgacatatctctgcatccatcacctaggagatgtgactctcctctcgtgcctggccccagccaaaaggggggatcgtgacatgtcactggattcatcacctaggtgatgggactcctcttttgtcttggccccacatactgtgggtattgtgacataatgctgggcccaacacctgggtgatggaaggctcctgcctgggccctgctcacagagagccttgtgacagatctctgcatccatcatcacctagatgatgtgactctcctgttctgcctgcaccttgcccatggggaagattgtaacatatccctgggtgctgttcccagtcttgcctcatggcctttgccccagctgtgtcctctgccctgcaggatgcacctctgctccgtgtggctccctcccactctcactctccaaatgccccgaacccctgagccccactgcagccccactgtaccctggctctgcagcgctgcttcttcatgatgtgtgtcttccaacagcagacgggggcatgaatgtggatgcctcattcactgctgtgtgccggcatccagagcaggactggagcccagagcaggcacctgactgatagttgttgaatgagtacagtaatgaatgacaatgaaagcactgtgtagaaacactggctgaatagtacctagaaagaaaatgtctcaaatacctacattagcaatgaaaaaaacactgctaattaatgaactaagcatctaattcaagaaacaaagcaacacagctaacttatagaaaaagtgaaaaaaataaaaaacataagatcaaaaactg

SEQ ID NO: 1030 - DNA, 2557 bp, Homo sapiens
aacgtttctatctgcaaatcaagcaagcgcttgggcgaacatcttcccaaggcagagatgaagaatggatttcagctacagaaggcaggaatcctttggacttggccctttatcagtggaatggacagagcagctctcggtggggtctctgttgggaatgcctgctgagacgggaccaaggacggctgcaggatgtggtgtctgtgctcagcgtcacctcctcccaggctcctgggaagcacctgagcatctcctgacaaagccaccatgagcaagaccctcagagaaggtatgaagatgagaggctggtgtgaagaggctgctgtgaagcaactatatagcatcgggcaggacataaggggaaattgttgctttcatgttcctttacccccacagtttggatttctgccacaaggatcactgtggtcttcctccctggggctcactccacctaccccacacctcccacctcccccgtcctctcttgggggacttcctgagttctcgacagagcagtttcactgtcttctctccacgcttcctggactggcccgcccatttttttctatgacccagaattccttcccaaataagagcgtcatattccttgagccccttcactagaagcaaggagatgggcaggcgttgaactgcggcttttctctagactcttccctaatccctaggttcccccaactatttagtctagagcaagcccaggaacagtgattttttttttttaacctgccatttctgttattcaagctgttttagtcagttcaggctgctgtaacaaaaatgcaatggcctgggtggttttaacaacagaaatggatttctcacagttcttgtgaggctgggacgcaggaacccccacatccaagtgccaggcagttccgtggctgggagggctccagactggtgtgtggatggcaccttctgctgtgtcctcacatggctgagagatgggtcatctctgttcttatcagggcactaatcccattcacaaggccccccatgacctaatcacctcctaaatgccccgcttcctaataccagcaccttggaaaatagggcttcaagatacaaattttgggggactcaaacattccatccatagcacccgctcatgtgctgtgatgtccagtgagcaggcggagttccagggctggtcagtgccaggtgctccttctcccacccgagaacaggggccaggttgctcctcaggcaccctgggcaactgccccttcccttccagtggggcctgacctggctaccgagcttggcagctaataggcgggcccctcagcattcacgctcctgggctgctttatcaaactaggattgttcccccaggtctaagaaaaccatccattcactgcaaagttatttattactgcggatgggctaggagttagaggaagagagtgactcaaatcacaacacctcctggacgaagctggaagggattaaaatacggcctaatttctcccttgctgtgtgaagcgtgtggttctcctagaacatcagcccgactgtcgctgggtagcggcggtactgttcattctgcattagctttgtccagattgttcagtgtgggtccctgcctacagatcttgattccttgagattgccctttgtgcttctgtctggggactgcctgtttctgtaatggccaccgtctcagaacacatggttgtaggcctcagcatttgccttacacacagcccccttggagacaaaccgtgtctgtgtccctcagaaggccctgactttcagggcacactccagcctgactttggcactctgctagacacatccgaaacgctggttctcgtgttgaagtctgttatggatatgtagggtaaggcagggaaactggagcgcctgcatacccttgacttcctccatttggaaaagataaccctgagacatggtggaggagaaggggccctgacctgtcagctacatctggatgtaactcccctgatgaagaaagtgccagaggcagcaaagcagcccttatagggtattttgtgctcccccaacagaggaagaggagcttagggtctccagggagaatgtctggttgtgaagagccgccaggacctggagctgcacggttgctcagtgtgcatttcacttggtcagcccctacgctggagagtgcttgcatccgaaccttcagtgcctggatagacactgagctgagcgaacggtatgctggaaaatgaagcgtgcaagtgacaaagtgctcaacttagactctgggcaaaattctcacaaagggctttctaatcctcacttaatggaagagtggagcaatttccagcagaagttgtggcttgcttcaccaggtctgctcaggtcagcggggtgagcctacggccaggatgggtggtaattaatattggaatacttggccagtctgcagacctcagaccacaaaaaaccctccatcctcaagcagtctcttctttatgcctcgcaaggggaagataattaaagactgtggtaacgggttaatttataggaaaataatgtagcatactcaact

SEQ ID NO: 1031 - DNA, 1903 bp, Homo sapiens
actgtgctgtcactctggaattctgctgtgtgggagctgaggccccacctgcagacctgctgctcacctgggcaggtgcctcctcacagcccatctgcacagctggcctgcggagtcctcctcaggggccactggccctcacctgccactgttgaagggatgcctgcccctgctctccccacctcagccatggccgtgcaggtgcccctgtggcaccactacctgcaggccatccggtcccgggaggcgccgcgtgcccaggacttccagcgcgcagagaacgtgctgctcacggtgctggagcgcgtgcatgccctggacccccgcttcatcgtggactactcccgtggcctggaggccttccagttcgccctgcgctcctctgaggacccaatggacatggaggtgcccctgtgggtggatgccgaggctctactgattgaggaaccagaggccacccagccggaggatggccttgaattatgccacctgggtgtgcccagggaaggggctggcctggagcggtggaccaccgaggataccttcactgcctcctcggagggtgacgccaagtgccgtggacacattgtgcccagcaaggtcctgtgtgtcctcaaggacctgctggtagcagccatcgtacactgcaagcaccacagtctcatcgcaccaggttcgctgaacgcggccagcctgagggaggagcagctccacctgtccttgctggtgtccagcggctggagaacaatcagcttccacgtggtgcccgtggtgagaaggaagcttggggcgcctgccctggagggggtgcagcagatgcccggattccctgagggcagcttgagaaggatcctcagccaaggggtggacctggtgccggccagcgcccagctctggaggacctccactgactacctgctcacgaggctgctgggggagctgggctccctgcagggtcatcgcctggacagcctctccatcctcgaccgggtcaaccacgagagctggcgtgacagtggccagactgacggcctgacctttggccacctgaagatggtgctgctgtgggcctctgtgctcttcccggcgcccgaggactgggcagaactgcagggcgccgtgtaccgcctgctggtggtgctgctctgttgcctggccacgcggaagctgccccacttcctccacccgcagcgcaacctgctgcagggcagcggcctggaccttggtgccatctaccagcgcgtggagggcttcgccagccagcccgaggcggccctgcgcatccacgccacccacctgggccgcagccccccgccgcgcatcggctccgggctcaaggcgctcctgcagctgccagccagtgaccccacttactgggccactgcctacttcgacgtcctgctggacaagttccaggtcttcaacatccaggataaggaccggatctctgccatgcagagcatcttccagaaaaccaggactctgggaggcgaggagagctgagctgggccacctggtctcagccacctgttcttggctccccaacagactctgcactgcaccatgggaggctcctgggatgtttggaagaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctgcactgtatgccattccttggtgatgaaatgctgtatatttggttttgaaaaaatgaatgtgctgggtatacacagc

SEQ ID NO: 1032 - DNA, 2582 bp, Homo sapiens
agcaacagcccagccctagcttgggagcggacccacacgaactgctcaaaggcttggagcgggtctagtaaggcgaacggactgcttccggccagaggtcccgggcggaggaggaagctgtggctgccggcggtgggacgccccggccgctcagcccccgggcactgctgtggggcgttcagctttccacacttggggcaaagcaagccgcgaggaggaaccagacagtcctgttagttgtggccagccctcattccctggaaatggcaaacaaggggaaaaagaagcgtcggcagttctctctggaggagaaaatgaaagttgtgggagctgtagactcaggcaagaggaaaggtgatgtggcaaaagaatttggtatcactccctctactttatctacattcttaaaggatcgcaccaaatttgaagaaaaggtgcgggaggcatccgtgggaccccagcggaaaaggatgaggagcgctctttatgatgacattgataaggctgtttttgcttggtttcaagaaatccatgccaaaaacattcttgtgactggttctgtcattcggaaaaaagcactaaacttggccaacatgcttggctatgacaattttcaagcaagtgtgggctggctgaacagatttagagatcgccacggaattgctttgaaagcagtctgtagagaagatagtgacaggttaatgaatggtctaggaatagataagattaatgagtggcatgcaggggaaattataaaactgattgctgactacagcccagatgatatctttaatgctgatgagacaggagtgtttttccagttgcttccccagcacacacttgctgctaaaggagaccactgtagagggggcaagaaagcaaagcagcggttgacagcactcttttgttgcaatgcctcggggactgaaaaaatgagaccattgattgttggtaggtcagccagcccacactgcctcaagaacattcattccctcccttgtgattaccgagccaaccagtgggcttggatgacaagggatctgtttaatgagtggctgatgcaagtggatgccaggatgaagagggcggaacgccggatcctcttgctcatagacaactgctctgctcataacatgcttccacacttggaaaggattcaggttgggtatctgccctccaactgtactgctgtcctgcagccactgaatcttggcataattcacaccatgaaagtactgtaccagagccaccttctaaaacagatcctcctcaagctcaacagcagtgaggatcaagaagaggtggacatcaagcaggccatcgacatgattgctgcagcgtggtggtcagtcaagccatccacagtggtgaaatgttggcagaaggcaggcatcgtccctatggaatttgcagaatgtgacacagaatcagcagccagtgaaccagacattgccattgaaaagttgtggcacacagtggctattgccacctgtgtcccaaatgaagtaaatttccaggactttgttactgcagatgatgatctcattatctctcaggacacagacatcatccaggacatggtggctggcgaaaataccagtgaagcaggaagtgaagatgaaggggaggtatctttaccagagcaaccaaaagtcaccatcacagaagccatatcaagtgtacagaaacttagacagttcctttccacttgtgtagacattcctgatgccatttttggacaattaaatggcatagatgaatatttaatgaaaagagtgacacaaacccttattgattccaaaattacagatttcctccaaacgaaataatgcaggaatttatttcagaaaatgtagtttacaataataaagatttctttagataggttgttgagccaatttaagtaaagcaatgttattgtgacaacattccagtactctgaaatagccaggaaacttctttgaatggaatttgactaatatgtgtgttttcttttcttttgtttttggctgtctctggtccttgattcaagatgtattttgattcatccaagggtttccaaacttgtctgcaaattgggatcacttgagaatcctttaaaaattccaaagctcaggccatatcccaggcctattaaatcacaatctttggtgacgggtcacaggcattggtagttttgaagctctccaggtgattccaatgtgcagacaaatttgaaaactgaaccaaccacaggaacatcaagtacactgtgggcctgggtccagcttctttccagtaagtgtatctcaggggcttccaaatttagcttacatcagaatcacttggaaggcttgttaaaacccaaggctgctaggcccacccccagagtttgatacagtagacctcaggtgggacccaaaaatttgcatttctaacacattctcagctgatgcagtccaggctccatgctttgaaaaccactggtctagctttagataggatattgagccaatttaaataaagcaatatactggtctagctgagttctagaacttctctctttagctggccatctgaatactcccccatcactaattgtt

SEQ ID NO: 1033 - DNA, 2692 bp, Homo sapiens
atcaaaaagaaatgaggggaatggctggtccagccattggagctgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcactgcacattatcactcgcttccagctcaagacaacttggttctcaaacgggctcagagcgtaaacaaactcgtgagtgaggtggagtataagaaggatctggaaagtagtagaggtcacagtatcaactactgtgaaacacctcaattcaggaacgtgagcaagatctcaaaatttaccagtgataataaatataaagaaaactaccagaaccacatgagaggccgctatgaaggagttggtatggacagacgcactctgcatgctatgaaagttggcaacctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagcttggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatgaagggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagtgattttctctacagacatgactttgtgaaggagcgagggaaactcatagggccccagagtgtaagagacgacccccggatccagcactgccggcgcatgggccagctgcagagcgagcttcagtacaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagc

SEQ ID NO: 1034 - DNA, 2285 bp, Homo sapiens
ctgaggaaagaagacacttccaaagtaacaaatgggaggaagcagccaacgcccgaggacaacatggcaagaaggagcctttggattccggactgggatggaaagagagttgattgaatcccggaatttggaaaccccagatacggagggcggacggtacaaccggagctgtcaggtggatttccaaggctttgcattggctgtacctgaaacttatggtggcctagactccccagtatccactcttccttatcttgaatcttgctctgtcacccaggctggagtgcaatggtgcaatctcaagctcactgcaacctctgtgcaggttcaagtggagaatctgaatcttgatgatataattggaactcttcagccaagccatatctaacagaactatcttcaacttttcagttgagaaggagtctcgctctattgcccaggctggagtgcagaggcacgatctcggctcactgcaacctccgactcccaggttcaagcaattctcccacctcagcctccggactagctgggattacaggtgcatgccaccatgcccggctaatttttgtatctttagtagagacaaggtttcgccatgttggccaggcttgtcttgaactcttgacctcaagtgatctgcccgcctctgcctctcaaaatgctgggattacaggcgtgagccaccacgcctggctccctagattgatttcatgtcttggctatattgtgaataatgctgcaatgaatatgggagtgccaatatctctttgacatactgattgcatttcctttggatatatacacagcagtgggattggattatactatagttatatttttaatttttttgaggaaacgttatactgttttccataataactatactaatttatgttcccacaaacagggcacaagtgtttccttttccttttctccatatccttaccaagacttgctgtgttttctcttttttgataatagttattctaacaagtgtgaggtaatataaatatctcattgtagttttttgtttgtttgtttttgtttgtttttgagactgagtctggctttgttgctcaggctggagtgcagtggtgcgatctcagctcactgcaacctctgcctcctgggttcaagcgattctgctgcctcagccttctgagtagctggcattacaggtgcgtgccaccatgcccagctaattttttgtatttttagtagagatggggtttcaccatgttagccaggatggtctcaatctcctgaccttgtgatcctcccgcctcggtctcccaaagtgctgggattacatgtgtgagccactacacccggccctgttgtttcattcttttatctttctgtttcatctcatttaatcaccacaataacccgacaagacaggaactattattatccccgtttttctttttctttttttcttttttatggcaggggggagtgcagtttcactcttgccacctaggctggagtgcaatggcgcaatctgggctcactgcaacctccgcctcctgtgttcaagtgattctcctgcctcagcctcccaagtagctgggattacaggcatgcaccaccacgcccagctaatttttgtttttagtgttttagagatgggatttcatcatgttggccaggctgatcttgaattcctgacctcagttgatcagcccaccttggcctcctaaagtgttgggattacaggtgtgaaccaccacgcccaacctcattgtagttttaattcacattccctgatgatgagtgggttgactatttttccatatacctgtcggccatttgtatgtcttcttttgagaaatgtctatttaggttctttgctcattttaaaatcaggttgtcttcttgctattgacttgtttgagttccttatatatttttgataatgatcccttatcagaagtgttgtttgcacatattttctccctctctgtaggtcatctttttactctgttgattgtttcttttgctgtgcagaagctttttagtttgatgtaattctattaggttttccagtatgactgggggaatagtgtattatgtattcttttgtgtctggtctgctcttctctccactcaacattgtatctgtaagatttatttgtgttattttatgtatcagtagtttgttacttattgatagatgtttaacattccaatatgcaaacaaactacatttatttacaaattttattattgatggacatttagattgtttggggttactatgaataaaattgccatggacattt

SEQ ID NO: 1035 - DNA, 2122 bp, Homo sapiens
aaaatggcggcttcaatatcagtcccactgagcatgaaattcatttacttaaataaaatctgaatctcagcccaaacctgggagattcaaaacctgagagcggtcttaccaaagacgcccgtatgtctggtgaagtcagttggatgcaagcagtttgtgctggtaccagggccccagctactgatgaagtggcaggagtccacagaagcctacttcgaagttcccggggcttccaggggagattgacgagattcctggggaggcgattcatgacagctgagttccttttggaggatccgtcttcaggcagtctgatcccccaggaaagcagctggaaaacaagagcatgtgaaggaagcgcagcagctcctcgccagccagacagccagccccgcaccgcaggagtcgacatgcacggcagcctagacgccatcagttaaacttatatgtaggcttgttgaggaaaacgactttcaaacacaaggcaaaagaaaaacatgaaaccaagggttccaacattcatcatccagtttcagagacacccttgaaggaatgctacagcctgtttcttacccattcaaaccagtcgctctgctgcatacccacatcacaggaggccctcagccccgacacacaggctcactcagcccagggacatcagcacctgtgccagctccgcaaggtatccaccatgcggccagaactgaggcccagcaatagctgaaatgtcctttaaattaacatgtacaacacacaacccccaagagctgacatccccaaagccccaccacaaatagctgactcctacttatacctgcaggagcaggtactgacctctgcaattctaaaccgtccactttgggcaaaattcatcaagctatggatatgaaaaaaggcccccaaggatatgattcatagtccagcgtttgagtgagcactccagtcagaacgaactctgcattgtgaacatctgaacagggtggaaacagacactttagttagagatccactgctgtgcgtgcacacatactcacacaggaaaagaaaatgagtttctcagtgaccgaacgctgaatgtgatacagggcaatgacggactcgctggcggactccactctacccaccgagttctgcttgtgctccatgagcttccggaaagatggctgcttggataacacctttcctcctgcacactctacgattgccttcatagtggaaagacttgggcagattccagtaaagaaaagttctctagagatgtgctgtggttcacaggaggaagacctccagtggcaatgtccaagaaggaagccaagagtgtaccttaaagagtggagaaacgtgtgcccgttttaaggattcttccaagctgaaagagaaaagtacttctgcctcagcatctcggagaatgtagttctgctcatctggaaaacagaacagcacatactctgaaaagtgtggacacgtgaagtgtggcaagtgtgacccacaaaattctcgcccatattcagcgtatggaccagtttgctgactgctgggcaggagcaaccacatcatgacagaaatgcagggatctgttcaccaacggccagaaatacaaaatcaatccctgagtcaaccagcagatagaaaggctgctttttaggtgaaaggagaaaaagaatgtctaaaatttggaaaaacaaaaaatgatgaattaaaaaaggatcaaaaaaagtactgttacacatgagatggtatatttgaagtgttactttcaaagctgatatgccttctgaagaacttgtgtgagatcaccaagaatagttaatgtttatgatagagaaaacaccaccgggcgcggtggctcacgcctataatcccagcactttgggaggccgaggtgggcggatctcttgaggtcaggagttcaagaccagcctggccaacatggtgaaaccctgtctctactaaaaaatacaaaaaaatttagccaggcgtcgtcgtggtgggcgcctgcagtcccagctactagggaggctgaggcaggagaatggcttgaacccaggaggcagaggttgtagtaagccaatggcaccactctactccagcctgagcaacagactgggtgagactctgtctt

SEQ ID NO: 1036 - DNA, 2151 bp, Homo sapiens
actgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcttgtggccacctcagacatcacttctctttggaagactccattaaatatttctctgtg

SEQ ID NO: 1037 - DNA, 2011 bp, Homo sapiens
cactcctcagatacgcagcgtctgtttacacatttgcctgcatagcatgatcaggaagcacacacacacacacacacacacacacacacgcatgcatgcacacaccatgcaggtgacttccccaggaactagtgccagcacccctgctgcagggggggatatcaaggctaaatggaagagaggggtgacttgcctgggagcacagggcaaagccaggacagcaaaccaggcctcctggtgctaccccaccagctgccctcacagggtggaaggtacagccatagtgggtgcctgcattgccctcccctcacctggcccagccatgctaccccaagctcagccctgtgaccagctctcccagagctgacactcgggctcaacccctatacctgagccttttttgctgcctccaaaacagcctcatctgcagttgcttgaaatagaaagtgatgagagcaataaattattttctataaatctgctgggaatgaagccctctttctggtcaagccaggcagctcatgtggcaaaggccagaactgcgcagtccacactctgtcaccctccaggccctgtgtcatcaaaactggcagaaggctaatcccatgggcaggttatggaagaggctgagggcatcttgatctgattgctgggggatactcaaacctttagctcaccttgcttctcccctccacctgagctgcagcctggaaaaggaggcacccacaggtctaaacatggccctgctttttttttcctgaaaattccaataacaaaagcaacgagagcctctcactaccaggccttctctcactttgctataaaattagttcacccctctttcttagagtgttgaggtccctgccctccccacctccctcccctgaaacaagttgaaaatatcttaatgaacatagaacagtgataaaggaagtgtttgaagtcctctttgtacagagagagagagaaagagaatgccaaagctaggttggaggaagtagaagggtatacggtgggctcaggcccatgggggccacacagaggagctctgtgcacttcagagaccagagcttccagggagcttccggccaccacaggaagcagcctagtcaggcattttatttcaatggataattcagtggtcttactcagaaatcaagaacgagacagaaaagtgataggctaagtgtaacgtatggccccagggcagccatggggcagaactagaagaaagcaaaatatctaactgggcacagcttgagaggtgaggggaaggtggggctgggaacgagtagagatgaggcaatgcagccaggagcagggactgaggggcacaggcctcctgcaccactgccccaccccaccaaccacctcttctgtctccaggaagcagcttctagagctagcattcttctggaggacatgcattatttgggcaaaatacaaagaaatatacaagcctaagtcaagtaagggaatgcctcccacccttgctattttctctaaatagagaggctgagtacagacgcggaaagaaacaaggaggtgtgggagcagcccgccatgctagagaaagactacattcctgccactaacggtcggtggccactgggcaaatcttaagtctgtggtgcctcagtttcctcatatgcaaagcgggtttgttccataggcctctgaggacaaaatgagattgcagaagtgagattgcagatggttagaaaagacaaagccacactggtgtgagttttcatggtccccgggaccacatcctcagaaggatccctcccacttctcctgggggttcctgcagttctgggacaggggcattccctgcagaccagacgtgaatgaagccgcttagccagcatcttgtgaacggcctgcctcatgtcctgagccacttacacatgtgttttttctccccagggtctacgaagaatagggtgaaaaacctcagaagggaaaactccaaaccagttgggagacttgtgcaaaggactttgcagat

SEQ ID NO: 1038 - DNA, 2352 bp, Homo sapiens
tgtagtaactgtagaaaagccttcagtcacaaggaaaaacttattaaacattataaaattcacagtagggagcagtcttacaaatgtaatgaatgtggtaaagctttcattaaaatgtcaaatctcattagacatcaaagaattcatactggagagaagccctatgcatgtaaggaatgttagaagtccttcagccagaaatcaaatcttattgatcatgaaaaaattcatactggagagaaaccttatgaatgtaatgagtgtggaaaagcattcagccagaagcaaagcctcattgcacatcagaaagttcatactggggagaaaccttatgcatgtaatgaatgtggtaaagccttccctcgaattgcatcccttgctcttcatatgagaagtcatacaggagaaaaaccttataaatgtgataaatgtggtaaagccttctctcagttttccatgcttattatacatgttagaattcatacaggtgaaaaaccctatgaatgtaatgagtgtggaaaagccttctctcaaagctcagcccttactgtacatatgagaagtcacactggtgagaaaccctatgaatgtaaggaatgcagaaaagccttcagccacaagaaaaacttcattacacaccagaaaattcatactagagagaaaccttatgagtgtaatgaatgtgggaaagcttttatacagatgtcaaatcttgttagacaccagagaattcatactggggaaaaaccctatatatgtaaggaatgtgggaaagcctttagccagaaatcaaatctcattgctcatgaaaaaattcattctggagagaaaccctatgaatgcaatgaatgtggtaaagccttcagccaaaagcaaaacttcattacacatcaaaaagttcatactggagagaaaccttatgattgtaatgaatgtggtaaagccttctctcaaattgcatcccttacccttcatttgagaagtcatacaggggaaaagccttatgaatgtgataaatgtggtaaagccttctctcagtgctcactgcttaatttacatatgagaagtcacacaggtgagaagccctatgtatgtaatgaatgtgggaaagccttctctcaaagaacttcccttattgtgcacatgggaggccatacaggtgaaaaaccctatgaatgtaataaatgtggaaaagccttctcccaaagctcatcccttactatacatatacgaggacatacaggtgagaaacccttcgactgtagtaaatgtggaaaagccttctctcaaatctcatctcttacccttcatatgagaaaacatacaggtgagaagccctatcactgtattgagtgtggcaaggctttcagccaaaagtcgcaccttgttagacaccagagaattcatactcattagaaaccctatgaatattgtgaatatggcaaggccatctgaaggaattaacacctcattgcacattacatgatcacttccagagtagaaaactatgaatgtgggatagccttctgaaaaagccacaaatttatgaaacattagagaattcttccaaggtgacaaattatataatgaaaaagctgttaccagaaactttcagcagacatcttattgataatatttaatcagcattctcattgaaatctgaaacaaggtatcttccatcagcataacaacacaacacttgagctcctagccaatgtattaagtaaggaaaacaagtatcaacgaagaactataaaaataacttttatacaagaaataattagaaaatgtgttgatagaaaacctaagaataaacacaacaatgagttaggtctttatcaagttataaaatatgttgaaaggcacaaaagaacacctgaaaaatgatattttgtctgaaaagacttgacattgtaaaaatataatttctctcccaaatcactaagtttaatatacttctgaagtttacatcagttttattttaaggaacttcacaaacttatccaaaaattttatgtggaaaagtaaagaaacacaaatagctgaaacaaacttgacaaagcaagtagagaagacacactctattattagatatatcatgtacttatttaaagctgctgtcatttaaacaatgtattaccaagtgaataaatcaagcagtagtaagatagtgagcattcatacaaaaatccaagaagatacaggaattctgtgtatgacagtgctattgaaatcactggggaatgaatggcttatttaataaatggaaggttcataggagaaaaattttagctttctactttatatcatatacaaaaataaaatccaactaaagaccagaatataaaaagc

SEQ ID NO: 1039 - DNA, 2942 bp, Homo sapiens
aaaaaaagtcattggcggctcccaagatggcgtccatcatggaagggccgctgagcaaatggactaacgtgatgaagggctggcagtaccgttggttcgtgctggactacaatgcaggactgctctcctactacacgtccaaggacaaaatgatgagaggctctcgcagaggatgtgttagactcagaggagctgtgattggtatagacgatgaggacgacagcaccttcacaataactgttgatcagaaaaccttccatttccaggcccgtgatgctgatgagcgagagaagtggatccatgccttagaagaaacaattcttcgacatactctccagcttcaaatcagtaccacacttgcttttttccagtcttctggtatctctccagttcttgaattttcaaaaataattggtttggattcaggatttgttcctagtgtccaagattttgataagaaacttacagaagctgatgcttacctacaaatcttgattgaacaattaaagctttttgatgacaagcttcaaaactgcaaagaagatgaacagagaaagaaaattgaaactctcaaagagacaacaaatagcatggtagaatcaattaaacactgcattgtgttgctgcagattgccaaaagtactattaatcccgtagatgcaatatatcaacctagtcctttggaacctgtgatcagcacaatgccttcccagactgtgttacctccagaacctgttcagttgtgtaagtcagagcagcgtccatcttccctaccagttggacctgtgttggctaccttgggacatcatcagactcctacaccaaatagtacaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagattcttctggatctgcctcagtcctgacacacagcagctcgggaaatagtctaaaacgcccagataccacagaatcacttaattcttccttgtccaatggaacaagtgatgctgacctgtttgattcacatgatgacagagatgatgatgcggaggcagggtctgtggaggagcacaagagcgttatcatgcatctcttgtcgcaggttagacttggaatggatcttactaaggtagttcttccaacgtttattcttgaaagaagatctcttttagaaatgtatgcagacttttttgcacatccggacctgtttgtgagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagaactagtttcagaaggaccagttccctgggtttccaaaaacagtgtaacatttgtggctgagcaggtttcccatcatccacccatttcagccttttatgctgagtgttttaacaagaagatacaattcaatgctcatatctggaccaaatcaaaattccttgggatgtcaattggggtgcacaacatagggcagggctgtgtctcatgtctagactatgatgaacattacattctcacattccccaatggctatggaaggtctatcctcacagtgccctgggtggaattaggaggagaatgcaatattaattgttccaaaacaggctatagtgcaaatatcatcttccacactaaacccttctatgggggcaagaagcacagaattactgccgagattttttctccaaatgacaagaagtctttttgctcaattgaaggggaatggaatggtgtgatgtatgcaaaatatgcaacaggggaaaatacagtctttgtagataccaagaagttgcctataatcaagaagaaagtgaggaagttggaagatcagaacgagtatgaatcccgcagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaaggttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttt

SEQ ID NO: 1040 - DNA, 2724 bp, Homo sapiens
tttaatgccaaacaattatactacaagttgaattcccattctcttttttctgccgtggaaactgcctgtttcactaaactctgctgcacacagaaaccctacacaaagtcctggcctgtggactgtgctggtgtggacaggcaccacgttttggagccaggcctgggccaagcactgagcatggggcctcacgtggcctcacgcagcctgtgtctgggctggagcccaggagaaacctgcccttcagatccggatgacggggcagcccataggagtgagcccgggaggatgctggagagccatggagggagctctgggcaggacccactgctcagggacaaggccagaggccccgagggagctgctaccttcagggcctcatccaagttcccgctggctgcgtggagtacctgctgggccgcgtgcgtggagtagcccatccctttcagaaacctgatgttctcgaggcggcgtcttttcttctctttttcctccttccttatttgggccagttcctttaggaaaacagcaaagtcccatcccaagttagggactgagatttcacagcctctcagtctgcgctctgcaggattctccgcatttccaggcaaagccaaaaaaccaaagcaaagcacagggggccctctttctacctctcctcacccagccaaatggcagaggtgccacagaggcagaggggtggtggaagtgctgcttctgaggcaggcagtggaagtgagatgcccgtggggcaggaaggaggtgcctcgccagccccgccatccaccatccggcatcaggatgggctgctcgccaacccagcactcccactgcagaggtcgcgggtgtgaggtgcatggattctcttctaggaaccaggtaggaaccgggtaggagagcttctgcacgcggtgggaaggccttccagccttcgatgaatcgcccagggattcaagttaaaatgtgatgtggaatcaggggctcctgggcaatgccaaagctggtgacccgccccccacagcctggggagcaaggactccagggccttctgaggcctgtcattccattcggaacccacagagtgcccagagacaaaggtcatctaacctcttggttctcaaccctgtttctcagagttgcctgctattgctgcaggagcgcaggacggctgcagagggttctagtctcttcacctctcccacccagggccaattaggagagttcccaatttattttgtaaactagtatccccataaaaatgtcatttaaaaaggggattttgctgcttaaaaacaacaacaacaaagcaagtttgaaaaccaggaatttaatccaacctcattattttcccaacaaggagacagaaagctttcaacaaagttaagtgacttgctacattctcccagggagaccagccccaccatcagcagcagcgaggacgggggagaaaacagactccttccttccagagacctgatcctgcctcctgcccagcccaggcaacaggcgcctccctgcattttccccacagcaggaaagcggcctcatctcttaggaaaacaaaagcatcatcattgtggaaccagactccacaggccccacagtaggagcaggcagaacagagtggctgctggaaacatctccagggatgaagacatctgtagactcatggcctgtctctatcacaggagaacctcctggtgtggccctggagtgcccacagcgccagctccctttgcttccccttcagctgcaccaggcctgtctcatgcccccattacgtgctctacctctcagtggccagtctcccccagctccagccccgctgcacagggcagcaggctccgtcattccagtcacctacctgaaagcccgcagcagctcctgaccacctccccacactgaggcaccagctccttattctgctactcagggcccccactccctggccccaacaatgcttcgaaactgaccttatcctgccacaccaccccaaccacacacgccagcaggagtctttcataccactcacatttgcacttttatttacacatactccatgtaaaatgcctttactggccccatcctctgctttcaatacagtttcttccatttatattccaaaaggctaagaagcgcacctaacatccaagcacagagaaggacgctgccagccagcggacctgggcattacctaacacagacctcacaccaactgggagcttcgaagaatacttcctttcattacaaatgtcttagtctgtttccttttaatcatgtaaacacgtgtgagaacattattttctgaaatttctctttatactaagatgagttagaaagataaagtagatcaaatcaatgacagtgagtactgcactgaagtggctacagttaagtagaaccagatctcaagagagaggcactgtatggtcacaacaagctgggatggcctcttaggaaggctacgtctcacggcctggccatgccgaagcatgatctgtgagctccgtttctacagctgttgcttttctcagatgagaaactggtctgtactcagggccatattgcacaaaaaatataaacttttaataattatgtattaaaggctgggtgcagtggctcacacctgtaatcccagcaccttgggaggccaaggtgggaggactgcttgaacccaggagttttgagactggcctgggcaacatggtgagaccccatttctac

SEQ ID NO: 1041 - DNA, 3197 bp, Homo sapiens
tgtgtattgagggaaggggagatgtgtgcaacaccttccagaaaaatggggaggtagtttagaaagtttttctctgtaacagcacagcttctgagaaggcagagagaagaaagcagacaggaaacgaatcccttcctcctctcccctttacccccttccttcactccctagaccaagctggtcacccggctgggaatcaagattgcgtggctgggaagacaccagtctctgtgctcgggttcagcccagtcgggcaagaaagtctgggcagctggagaaggtcgtcacagtctcccgtggaatcttgttgcctgagagccccataacggaaagggctaagacgactcttccacacacaggtcgcagcccctgccgcggaggatccccaggaagatgctggggacgctctgagcatcggcctttctttacccccgactccctggagcttggtctcgggatgccaacttggggcacggaggcgacgggctgctccgaagctggagggtttctgcttgggtcagagggatcacgacctcagcagagccaggagaggttgggtgacacccactgcgtattgcacttgactcaaaactgccctcggcctgcggaagaggcgagggcaagaagcctggtggcgggtcaaaccttcaccctattattttctatcattttttatgcccatatatttgttaaatgtatggctgctatacaccaacagcttattctacaagaagtgcccccgaggaggattgggttaagctttgcaaatttggcttcccaggtaatgcgcttcattattctgctcccgacttacccaccacaccagtgggtacccggagcagcacccacttggcagaactgatgactgcttgggcccagcggagtgcgcattgcgctaacacgcgcacgggaattgcacccttgccggagcctccgcaccgtgcgcccttcaaagagctggcgaccccgctcacgtgtaagcaacctcccactttgaaactaattcgcacccgggtctttcaccccaaaggactttgctgcggacgctgctctgacccaagacgcgggagagaagtcccaaaggctacagccaggggctgggggactcctctgctcaccttagtccttgatttcgaaggccccaattaactatctgttgtgtcagaatcggcgagtgcaaagtagctgcgccccgctgacgcgctctctcctgggtccgggtatcccagggcatccggagctggggagggttgtgcggactacccaaggcacgcgcagataccgggcagggaagaagggctccgtgttccaaggatggtcgtttacctctcctgagatcagccctaatcccttggtaacttaagcgcctctgaactcggggagcgcttggtggggcgcccccctgcatccacccctacccctggctccttcccaggcccagcatctttcccaccattctcacccccaccacccccacggccccgcccgtttagaggcgtgcggtgggcacttggtttacagaaccggcgtttcagatgtttatttgcaactaatttcttgtgctggaaaatgcttgttacccgggcggagcgcttccgctctgcgcggtccggcccggcgggcggtagctcgctgatccctccggcgaagcctccaaggagtgggcggctgggagaggttgtgccacccgggaccaagccatcggcgctgctccggactcccggtagggggagccgccgcgggcgccaggccggattgtgttctggcctcggggcggccctgctgccagcggccgggactctcagcacagagctcgggaggactccacctgctctccagataaggcgccatgagcagagaagggaacagacggccaagctccctcctaattccccgttgttgcagagcaaagaagatgggggagaactaattatattctctaggtctaaatattgttgaaaaatttgtaggtgagatcacctcctttgcccatatccatatataatatatccattacatgtgtttgcccatatatatacgtatgccatatgtaaatatgtacgagtgtgtatgtatgtgtatagcagtggtttagaattagtctcagttccacaaattttgagcccttttaatattttaggtgacctaataccttctcactgtattttccaagtcacttatttccaagagttttaggtgatcccagcataggagctgagcataggagctcagatgagacttgccagttttgctgcagtaatgtcagcaaaagagtctctctctttctgactctatagacttaagtaagggtttacaggctttcattttaaggtatgactgatatttagagaacaagactaaaccaaggtcaaggggaaaacagttagactgtgaacctgcagaccactccactgcacccagtgtggccgtacacctgtgctgaacggccagagacttcctggtcaatactcccacagataaaagactgcaggatctgcttatacacaaatccatctttcgctgggaacccacaactcataacaactctcctaatgccaagtcatcaaggcctcttgaaagagaatcataaaaaacaaagaatttcaaacttggaaggaaacctaaagtttactggtgaggagcttgaactgagtagaagcaaagaatcatactccagatgagaaacgccccatgcactgagctgagactggaactctcctcttcttactctcagtccaacaacatcactcaaacaaccctattacttcagtagcaatgaactgtctctggattttattaagcatctcactagttccttttcttcagctgtatggcaccctgtcttcctgtacaccagaggctcctcagctgggtaaggtgagccaacgttaccaggagtatatgctgagaggccatttcaaagtctttcatagaaggctgtgcttgggcaagtagaacttttcatcatacagtcccagagatgtgaagttatcaaggtcagagaagaggaaaagagactcagagaaactgtgttctctagtctttcattcgggaacaaatggtgtcgtaccaaatggctaaaaagatcccaggcttactctgagaaacatctctctcttctgaattaaacttgcacagtggttaacagtgttttgtttggtgttgacaaagtaataaaacgttaccgtttctctttc

SEQ ID NO: 1042 - DNA, 3425 bp, Homo sapiens
atgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccagggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaaggtaggtagaccactggaaggtacatctggttttatattttgtcctgtagaagtcagatttcagcccagttgtgtaggagtgaggatgagcttatgctcttatcagagctttgagtacagagacatttgatctggaatttcagccagcctcttcaaccccagaattcagaggttcaatcagaacagacattagcttaagttttcccatcagttgtctatcattaaactggcaaaatctagataattagaaaatatgacagagatgatccagacagagatgttcaggtttttccttgtgtaattcaaaaagtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactctttatcttctcatcttactggcctggtctgtggcagcaagcacattatttccattccccaaatatgtttaggtctcccaagaaagctgggactggcggtaatgagcaagtaaataacttgaaaaagaactgtagatgccccaaggaaccaaccaacataatttccagggggtgattttgtttttagaagagctgctcccctctgttaggaccagccaagtcacatttttggacgtccgtggactctgatcaccacagccctcctcttccgtgagccttccttactctctcgagtgcattagctcattttttttcttttgctggttgtcaccttattcctgttttagtttttagcagcttaaaatacgacctctcaggaatatttgcaagtgaaaataacaatggtccttacactaccacaacatttggtggtgggagttccgttgcaggtctcagctataacatagtcatttatgagggatcttacaaatagtgtgtaatggtatttatatttgtgagtgttacactttctctatagacttagagcagctttcaggtttatttcagtaataatgtctttctcaccttctcacattgtgaagtgtttacctgagtcagggagagagtttaatggggttatctgtcggggtgccatgaatgctgatgatggtctgcaggttgtgaacatcagccccattgctacaggggtggacaggtggaaaagctcagacttgacaaaccacctctgctagatagatgtgtcttggaaatccagaaattacagtgaatattttatggaatgccagtgagcagacagcatttcccactttcctatcttaccttgagggtaagacttaaaggtatttttttttcttgtaatttgaagcctaaattctttgattgtttgatgtatgcaatatgatgtaaggcacattttatacccctagtcagtggtttcccttggattcattctcctacttgattgaacccatttaagtcattttaggaaatggtggtttgctattaaaattaattggagagaatacttggtcattctgttagcaaaaagagactgatggagcatggtgttttatggattctgttacagggcttattcctccttgaataatgtgctttaaaaattattgtccattcgattacattttcttttattttcctacaatgtaagcacggttttagtcctgtaggtcagcctttctcacaaactcttttgaactaagatttgcctaggtgaataaattggggatgacggttgtctggagaagatataaggtccatttgtgaatactctgcactatgagaccaggagaaaaatcatctaagaaatcgttcactcttgctaaaaactgaactaaattttatatgatgcatttattcagcaatcataagtgctgtgcataactattgtacatatttttggacaatttcttagggttcagcttaaaaatataatttgcctactgcaact

SEQ ID NO: 1043 - DNA, 4304 bp, Homo sapiens
gtaaatgctccctaggctggctgcggctacaaggcagacccgggagctgagaatagaggaatacctgcccaagcaactcattctgcacagcagccgacaagatagcgattttcctgtgctggaatgtgcccatccaaggccaaccaatttgttggaaaatcagtcaaaatctaattttgatgttctgcaagttccctgggggccatgaagcacctgacacttggattggacttaatcttaaacctctggagttcaagaccttttaaaaagggctaaataaacaatctctacatgtaaaaggccactgactcctacttcctctgtatagagcaactgttgaactcagctgcctgtaggaaaactgaagactttaataacaaactctccaaggtgaaaatgaacacagatagcggtgggtgtgctcgcaaacgtgccgccatgtctgttacgctaacatctgtgaagagagtgcaaagttctccaaacctattggctgcagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctcctcgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccccagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcgggagaatgccccgcagtgcctctttccaagacgtggacacagccaacagcagctgccaccaccaagaccgtggcggtgcactccaagaccgtgagtcccctagaagttactcatccactttgactgacatggggagaagtgcaccaagggaaagaagaggaactccagaaaaagagaaattgcctgcaaaagctgtttatgattttaaggctcagacatctaaggagttgtcatttaagaaaggagatactgtcaacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcatcttccctgtttcctatgtggaggtcgtcaagaagaacacaaaaggtgctgaggactaccctgaccctccaataccccacagctattctagtgataggattcacagcttgagctcaaataagccacagcgtcctgtgtttactcatgaaaatattcaaggtgggggggaaccgtttcaggctctgtataactatactcccaggaatgaagatgagctggagctcagagaaagtgatgtcattgatgtcatggaaaagtgtgatgacggctggtttgtggggacctcaagaagaaccaaattctttggtactttccccggaaactacgtcaagaggctgtgaattgcgctccctccttctgtagaggccgcctgccagccatgcacctgcgtcaacgcgcctgaaacaccccgcgggcctcccgttgtcatgccttacggtttccaatgcgccgtcaccatctccacctgccaccaaaccaccagcagagtagccgccgctgctgtgagcctggggacgacatggcaggctggtccccctccgtgaaagtgtggattcctacttcctgctctaagctttgacacgtcaaaatgtgggatcagaaagaaaaaaatcatgatatttaaaaatggtcaaatatttgaggc

SEQ ID NO: 1044 - DNA, 2847 bp, Homo sapiens
tttccagtttgcagcggagcctccatcggttgattccagctggacggccgatctggtagcccggagtcctgggaaatcaaggagtcgaaggaacccgtgcaagtcgtcaatctgggcccacctctcccctgcctcaagccctgcccccagctcaagccctgccctctggggtggcgggggaagcgtctccagctgccaggggcgaggctagaggggcgctgcgggactaagggatggagcaaaccgacctctcggccctggccaggagatgaggcgggtccccggcttcctgctcccttcgcctacgcgtagggcctaccagacgcccgcctgtccaaccccaccccggggccaaaggccgacctggtacccactgtcagcagcctgcaggcaggtccccacagggcacggtcctctgcacctggtgacttcctcccgggtcactgccctctgcagggttgatcaagcctgaccaccccaccccccaggccgcaccccctactccgtcgaagactgaatgccccaccccaggaaaacgggcccgcaaaccgtggggtccgggagtgggcacctagatactcggctcccgacgcaagcctgccccggggaagacccaggagctgggaggcacgggagtactgccggggcatccgcggaaggcgtctgatacccacgtttcagaagagtcctgggatgcttggggtggcgtgggcttgcaaggcgctgctggtttttgccggggatttactatcacgtagtagtgaagttatgggggctctatggcacagagcatcactgggactccgggaccgatggtggcgccattgctgggaggcgtaaccagagacgctgggattagtgggtggggatgcggggtcactggaaagttactgagattctgaggattacaatactactgctgggaaaaccaggaggtgggtgggcacattcctggggtgcttatgagagcgggcctggggagggcgtccgggctccttggaagatactgagagatgctggaatattactgggatttttctgggaagctgaggatgtttctgacatcgctagaatattaatggaaattcgggggccgggagataggaatcccggagactccgagtcgttacttggaaaattcctgggtggccggtcctcttccacctcagggcacagctggctaccggtgtggaaacacctgccgagacgtggggggtatgggaacatcagaaagtctagagttaacaggaatcggaggacagatcgtgggaaagcggaggctcgctaacgaccctcgaagggacacccctgcgaggctaacggaaacccagactcacccaggggccgcagccggggtccactccgcgccaacaccgctagcgttccgcccggctccgcaggcacggcccctttaaattattcactcctagtcgcaccgcagtccctcccgaccctcccacccctcctccccgcgccatgcttggaaggccgactgaggccgccatgctgagtgtggccgcgccttaaagggcctcacaccgcttaacgcaaggactgctcctcccgctaaaaatgaaaacgacacatttattttcccttttattcaacaccctccccacccagtctccccgcccccaagggtccgacacgaaaggtccaggccctcctcgggcgcgacagggagccgatccttaaaagcaaaccctacaaataaataagcggggtcgggggcgggggtctctgcagtccagggcctacggtccaacggcagtcaggtcgaatcaattcaccagcagcgaatgctcctccgaggggtccctggaggaaggaagcagggaagaggggcgtcagttttctctggctcgctcccctttccccattccctaacctccaatctgaatgtgccagacccgggactcgaaccttccgcagcagcagagaaggctgcaggccgagccgctcccgcggcggaacttgccggaggtggggctgtcctggcactgtgcgatgtaggcccgcagctcgctctcctctgcgcctgcgccgccgggatgctggggagagaagccgggaggctcagcctgaaagtggctcccaacctccaaggcccttgaagtccgccctcccctccagccatatctgcatcgcttcccacctccgggcctttgcacttgctgggcctgctccacccgttgttccacagtttgcttgcacagagggaccttccctgacccctgaacctggatacaagctgtgtctttgccagtctgtgtctttgccttctgctgtaggtccagcacctacagacctagagccagggctgacatgacctcgatgctcagaaaccatctattgagtgagctggatgcacgctgagcacagcagtgggagcagggcctgagactgcccacctgagtggatgcatgtgtgtgatgtctacgtgctaaggcaagacaggaagtagttccaagggcctgagtcaatgtgtctgtgggacagctgaatccatgcatggggaaaagggggtgtacccatctgccggtgacattggatgtggcagggtcccagccaaggcttccttcctctcactcggcctcatggaggggccatcttttctccaagttttttcaggctactagacctttgctttagctattccttcccctcggtgcactgcccctgggctcccatctcttcagtctagaggcgatggaagtattcaatatctatgctgtccaatatggcagccaccagccacactggcttttgagcactggatacaggatggtgcaagtcagaggctaaatttgcaattgtacttcatttgaattaaaatttttaaaaaat

SEQ ID NO: 1045 - DNA, 2576 bp, Homo sapiens
agcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttggagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccttcttgaccttgcaagagagtttctgcccattttagggccacgttaccaaatcgatgtaggcctaatcacttcctcaaccctgttcaagcgtccctcccttgtgctcagtatattggtgtgaacacggaacatgatgggggatttacctgaccagccaccccatagcccctggctgaagaagaaagagcatcttctctcccactgcaccccttctcctccaagaatagttgcccacattcccaaaatgtggaaagacttttcttttccttccggaacatgttcttcaccaccttttggagatttaaccatagctgccaaagctatgcacccagttggccttagaaaaccacaatgtttacagccctgtcttagggccgcggcttctcttatcttccaccaccttccttgcttgcagggttatcttctcacagggctggaatgcaaatttcagaggcttcttttgaagattccccaagtcaagcaggcaagatgcctagatcttctgttatctttgacatgtaacatcctttttagaggctcagaacacctccttggctgctatctcatgtgttagaatccagtttgtggtgaacctctttggaaggggaccccctctctttaaaccctgttcctctgtcctggtaacattctccttctaggagagcctctcttctgagaaggtaaaggaagggctgggtgagacacacagctatcctaggagccgtaggaagacaaaacttcccttttgttttactcctcactcctctatttttgttttactcacttctttatattttgttttactcctcactcctgtatattttggtttacttactcctctatttcagaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagattttttttttttaatgtgcaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgt

SEQ ID NO: 1046 - DNA, 3057 bp, Homo sapiens
acaatggccggcccccgcgggtagtggagcccgtttgttccgcccgtgtcgagcctggagccagaacctgtgaagagcggaagggccaagggacgtcttctccacgccgctccgactccaggggagccgtggcctcctctccgccctagcgctgagaaccgtgggtaccgatggatgtggccgagagccctgaacgggatcctcactctccagaggatgaagagcagccacagggactctcggacgatgacattctgagggacagcgggtccgatcaggatttggacggggcgggggtgagggcttctgatctggaggatgaggaaagtgcagccagggggccgagccaggaggaggaagataatcactccgacgaggaggaccgggcaagtgagcctaaatcccaagaccaggactcagaggtgaatgagctgagccggggcccgaccagctccccctgcgaggaggagggggacgaaggggaggaagaccggacaagcgaccttagggatgaggcctcctcagtcaccagggagctggatgagcatgagctagactacgatgaggaggttcctgaggagccagctcccgccgtccaggaggacgaggctgagaaagcgggggctgaggatgatgaggagaagggcgaaggcactcccagggaggaggggaaggctggtgttcagagtgtgggagaaaaggaatccctggaggctgccaaggagaaaaagaaagaggacgatgatggagaaatcgatgatggggaaatagacgatgatgacctggaagaaggtgaagtgaaggaccccagtgacaggaaggtgaggcctcgtcccacctgccggttcttcatgaaagatgttgtgacaccattatccactcttcttccaccaatatccaattccataccattcagaggccaggttaaagggaactgtacctggggaatgaattgtaggtttatacaccctggagtgaacgacaaggggaaccactccctaatcaccaaagccgaccccttcccgcctaatggtgccccgcctctcggacctcacccgctgatgcccgccaacccttggggtgggccggtagttgatgaaattttgcctccaccccctccagagcccccaacagagagtgcctgggaacgaggactccggcatgcaaaggaggttttaaaaaaagcaactattcgaaaagaacaggagcctgattttgaagagaaaaggtttacggtgaccattggcgaagacgaacgggaatttgacaaagaaaatgaagtttttcgagattggaattctcggatcccgagagatgtcagagacacagtactcgagccttacgcagacccttattatgactatgaaattgagcggttttggcgtggcggacagtatgagaatttcagggtgcagtatacagaaacagagccgtatcataattaccgagaaagggagcgcgagcgagagcgggagcgcgagcgcgaccgggagaaggagcgggagaaggagaaggggaagcccaagccccgctccccgcagccgccaagccgccaagctgagccaccaaagaaggaggctgccaccacggggccgcaggtgaagagagcagatgagtggaaggacccttggcgccgatccaagtctcccaagaagaaactcggggtgtcggtctccccgagccgggctcgaaggcgtcggaaaacatcagcctcgtcagcctctgcctctaattcctccaggtcgtcttcgcggtcatcgtcctactctggctccggctcctcccggtcgcgatcccggtcttcatcctacagctcctactccagccgctcttccagacacagctcgttctcaggaagccggtccaggtcccggtccttctcttcgtccccgtccccgtccccaacaccttccccacatagaccttccatcagaaccaagggagagccggccccgccgcccgggaaagcaggagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggcggctgataaaggaagcaggaagcgctatgaaccatcagacaaggacaggcagagccctcctccagccaagcggcccaacacatccccagaccgaggttctcgggaccggaagtcaggtgggagactgggctccccgaagccagagcggcagagaggccagaactccaaagcccctgcagccccggctgacaggaagcgccagctgtcaccccagtccaagagctccagcaaggtcacgagcgtgcccggcaaagcctcggatcccggcgccgccagcaccaaatcagggaaggccagcacgctgtctcggcgggaggagctgctgaaacagctgaaggccgtggaggatgctattgcacgcaagcgggccaagatccccgggaaagcataggccgtgccccgaccggactggccgcatttttatacatagggtaagcgcagccattttggattttgcagttaatgtcttattttggctgtgattctttttaaaaagtaaaaaagaaaaaaaagtttctcagctggaaaagaagccacacaggaaatgacaacgacgctgaatcccagcctccctccccagagcagaagtcccgcaggacagacagacacagacagcgctagtgaccagcacggttctcatgtaaattacaagccccagccgccagccccgccttctcttcctcctcctccatcttcttccctggccctggtcaggcctgtggagccccagctctgggtccctagcccgggtccaggcagccaggctccctcctgagctgagaaacggaacctcgcgaaccactggtggcacatccttctcctcccccgcccctgatcacccgcccccggatcagaaatatatctatattctcgactaaagtctcatcaggaaatatttcctgtcttttattttaagcatcaaattgttttagttgattt

SEQ ID NO: 1047 - DNA, 3060 bp, Homo sapiens
gtgaaggcgagcagacgcggagaaaggacgcgggagtgagagagggtgagtcagccactgtctaaacgataacgggaggcggctctgcggggtagggttgaattcagtaaatgggcccgtgctgctgtctcttcggagacgctgctatcttagcgtcagcgagggaaggttgaggaggagccagagccgggtcctgcagcgtttctcgccatcagcgcccgtcgccactccaccatgcagtcccgggaagacgccccgcgctctcgccgcctagccagtccccgtggtgggaagcggcccaagaagattcacaaacccacagtttcggcctttttcacgggtccagaggaattaaaggacacggcccattctgcagccctgctggcacagctcaagtccttctacgatgcgcggcagctgtgtgatgtgaccatcgaggtggtgacgcctggcagcgggcctggcacgggtcgcctgttcccctgcaaccgcaatgtgctggccgcggcatgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaacgtggagcgcctgtacgcggcctccgacatgctacagctggaatatgtgcgggaagcctgtgcctccttcttagcccgacgtcttgacctgaccaactgcaccgccatcctcaagtttgcagatgcctttggccatcgcaagctgcgatcccaggcccagtcctatatagctcagaacttcaagcaactcagccacatgggttcaattcgggaggagactctagcagatctgaccctggcccagctgctggctgtcctgcgcttggatagtctggacgtggagagtgagcagacagtgtgccatgtggcagtgcagtggctggaggctgctcccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacaccccagagatccctttctctgctgtgacccatactcgggggacctttacaaagtgccgtcacctttgacctgtctggctcacactaggactgtcaccactctagctgtctgtatctctcctgaccatgacatctatctagctgctcagcccaggacagacctctgggtgtataaaccagctcagaatagttggcagcaacttgcagatcgcttgctgtgtcgtgagggcatggatgtggcatatctcaatggctatatctacattttgggggggcgagaccctattactggagttaagttgaaggaagtggaatgctacaatgttaagagaaaccagtgggcattggtggctccactgccccattcttttttatcctttgacctaatggtaattcgagactatctctatgctctcaacagtaagcgcatgttctgttatgatcctagccacaatatgtggctgaagtgcgtttctctgaagcgcaatgactttcaggaagcctgcgtcttcaatgaggagatctattgtatctgtgatatcccagtcatgaaggtctacaacccagttagggcagaatggaggcaaatgaataatattcccttggtctcagagaccaacaactacagaattatcaagcatggccaaaaattgttgctcatcacctctcgcaccccacagtggaaaaagaaccgggtgactgtgtatgaatatgatattaggggagaccaatggattaatataggtaccacattaggcctcttgcagtttgattctaactttttttgcctctctgctcgtgtttatccttcctgccttgaacctggtcagagtttcctcactgaagaagaagaaataccaagtgagtctagcactgaatgggacttaggtggattcagtgagccagactctgagtcaggaagttcaagttctctttctgatgatgatttttgggtgcgtgtagcgcctcagtgaaatgcacaggatcaacagggtttgttgtaactagattgaaacactaagttgtttttactgttttggaaaatatcttaaatatcctttttgttcctaaaggagaggaaaagttgattaacttctggtttggtttagaaaaagtaatgtttgaaatacgaaggtaatttaatgttacaaattttaacactcaaatcaaccttttaataattttctgtgctaagggtccagtatttatttgattatttagtatgtttatgtttcatgacactaatttagtcttttgatacattttacattctgtttactgccacaagcactgtggcaataacttttgaattttaatttttataatagaaaaatgattaggaattgctagatagtgttttgaaagcatatctttttcttcagaacaatgtagacttccaaaatggttaacctaaggggtccttacaaaatgtgttataagttaaacataatttgggaagttttacttttgttttcttctatgaagaaaaaaatgcaggctgggcgcggtggctcacgcctgtaatcctagcactttgggaggccgaggcaggtggatcacctgaggtcagttcaagaccagcctggccaacatggtgaaaccccgtctctactaaaaatacaaaaattagctggtcgtggtggcatgcgcctgtaatcccagctacccaggaggctgaggcaggagaattgctgaaacccgggagtcagaggctgcagagagccgagactgggccactgcactccagcctggatgacagagtgagactccgtctc

SEQ ID NO: 1048 - DNA, 2780 bp, Homo sapiens
aagatagcaaatacacccccttcctcttgtaacccggtcaggcctagggttcctccctgagttccagaataggccacccagttggggcggacccttaaggcattctgggcccacgcctgcctataaaccctcatagtgtgacctttgacccctggtgtgatcttgggcccgggctgggaccagcccctagtgtgggttgtgggggcggccatggagctgggcagctgcttcaagacctatgaggacttcaaggagtgcttcagcgcctacaaaagggagaacaggtgctccttcattctcagggactgcgtctccgtccgcttccacaacctcaaccatggcacctccatccgcgaagacatcctgtatgtgcaggtgaaatttgtctgcattcggacccaatcaaacaggaagagaacgcgggaggcagacatgtgcccagcgtacttgctcctaaggtacaacgagagactagatagactatttatcagtgaactaaacacacagcacatacatggtgactctaaagtggctagtcctggaggagacaccactggcaaatctcaaaagacaatgtgcctgcagagactccagcctgtgcagcccacaaccaaaaaagaccttgacactgccgagaagtccctggttgagccatcgttttgcctagataaggtacaagtgtcctcaaagccagagcaggaaggcatcactccttctgacctggccaagatagcaaaagtgatgaagaactttcttaaggtagatgagggttccatggcttccttcagtgtgggtgacagccagcacctggaccggctcagcttccagagcagtaagatgaccgacctgttcatccgcttcccagagaatctcttgctacaccgggtggagaacacccagggccacatcctctatgctttcttggtggagaacaaggaacgagaaagtcgagtggtgcactttgctgtgctcaaggcggagacagccacctctgtggccaagatgctgagcatcttcacagagttcaactccgattggcccaaggtcaaggtggtctttgtggacccttcattccattaccgggctatcctgcaggagatctttcctgctgcccgcatcctcctttccatctaccacacaacccgactcttggagaagaagttgcatcgtagttcagcaaatccatcctttaaaagtctcatgaaggaagccctgcgggaggccgtgtttgtcacttctgaagccagcctgaaaaatctctgccagatgtcccaggccgtactggatgaggatctcttcaacttcctgcaggcccactggttcacctgtgaactgctgtggtacatgcatgttaggaagggcctgcttgcgtgtaacacctacatggacagcctagacattgtcaccagcaaggtgtcaagcctctttcgagaacagcagtcgctgctggactgcatcctctgctttgtggattacatagacttctttaataccaaaggcttgaagaacttgcccacacctcctcccaaattaaagagagctcggccggcaagcatgccactgaagtccaagaaggcttttggaatctgtggagagagccttaccagcctccctgcagaagagaccaagccagacgcacagcaggtacaggtacagcagcagtcacaagtgccgccctcgcaggttggcatgctggacaccttgcaccagagtggctctgaactagcctacaagctgtgccacaatgagtgggaggtggtacagaactccacccacctggtggacatggctggctcttcagtggacgttcagctgctggaggactctcaccaggttagcaaagatggctgtagctgcagctgttcctttcaacaatggtaccacctgccatgccgacacattttggctctgctgcacaccagccagcagccggttggtgaagccatggtgtgccgccggtggcagaagaagtaccagtacctccttgggcccaatggggagctccaggatcgtggtatggtcccaaacacaggccagcctgagaagcaaggacggaacgacatgattcaggacctaagcagggagttagcaaacctgctcatgcagaccgaggggccagagctggaggaacgctactccaccctgcgcaagattgtggatatctgggctggcccctcccagccatctgagctctttcagcagccaggagactttaaggacgtgggccgcctccctttcctctggggaaagcaagaggaaggggagggattccctcctgctacagctgtgatgcattattgaagcactttagctgaagcattggaccacaaacacttctccttggaagtgtgagagtttaaagtgggcaggacatactagggtttagcattttagccaatgtcttcctaggtggggctaggaatattgttacagtagagaggaagggaactccactgtgtgacagtcctttcaatctgccccttttcagccctacttttggcattccttgggagcctcagttgttgttcaaggccaaagttatctccgtgctgcaaggtcaccctcttcctcccccagcccctgagatcagatcttatttgctctgcaaatatgaatccctgcctcaggttagggtgagacaaaatcggtctggtaaaagggcctgttttcagggacaaagggaatgaggatgatctttggctgttgctgctctttatgaagaatcttatttgtaactttttattcatattaaagttgtttttaataaaattaaacaaggg

SEQ ID NO: 1049 - DNA, 3015 bp, Homo sapiens
agtggttttcaaacacaggtgccccagggcacagggcatcagagtggaggcatggccacctcctctccatcgatgacctagagggggcccaggagacagacgtggacacaggcctgcggctgtcctcatcggacctgtctgtggtctctgcatattctgcacccagtaggttctgcagcacagtggagacacccctcccctccgaaagatgcagcagccactgggcagctcacaaggattccagggagggaccactgcccactgtcagcagggtgaccacagaggcctcctgggcttccctccctttcttcaccaaaaggtcttccagctcctcagcgacagctcgtgctgcccccccagctcccagcacctccaccctcacagactcctccccacagctcccatgcgataccctcaaagtcaagcagactgatggagacatgccaccacccccagggtcggctggccccggggataacgacatggaggaattctacatctgaatgccctctgctcttgttctcgaaacacacaaactcagagacacagactcaggccccactgcccctctggccactgagcacaccacattcttcatgatccatttcccaggagcccgtagcacatttgcctaccacccactcttagctggggggtggtatatctctagagacacagcagaaaaatactggcatttttatgcaaataaattctcaacaaacttgtcataaaatatattttttgaatattcagcatttgaggtatggtttagtgggtttatacaatttaaatggcttatataattatttgaaatgaaaagaaaacctagtcagccagaaccaatttggcaatttttccatggtatgaaggcaaatcaattaaggccaaaacgttgaatgtgggagagatagtaagtgacttgtatgagggattactgcataataacgtaacgcacaccttactggattctccatatatatttacattaccagagaacagtggccctagggatgtttaagcactgcttataatggaaaaagtcagcttgagaagtaaacgtatatcagactacaggtaattcctcatcttgaagccatgcaacacctgcaaatctggatttctacaaaagttgctaatgtgtttcataaagatttagcatgagtaacagactcttggtgcatttaaaatatgtgagttccagaaagtagatttgcatacaccttttcaacagcacatttcactggaatggatgaggggcttctgaagaccactccactacctgaatttatttggatcactgaggaagagcatttgttgggattacagaattataggccattagacatcatgggtaggtagtcttaagatccttcaactttcaaaaaccacagtctaaggactatattcaaatgacaagagccgcactgtatactgctttctgcagtgaccatgctgggtcacgcatcctatgtttctcatttttaaatgatttggaacattttagccagcattttgatcacacagattaataatgctgttctccccaaaacgggaaactttacctgaaacgctctcctgaacaaacaccagtgcactgccagcctcacatgattgcatgggagctttaattaacgctggagcccagcaaccttggcttttcctgcctgttatctgctactgtcacaccgtgaatggtatttgaatctcacctccctctcacctcagtaagagtatgtttgtttacagccccaacctcagcaatgccaaaggctggcatcgggggcagtgccaagctgtccctggatactatttacctttgaggaagaacagcatgggtttgccaagctcaattcccaggctggtgctccttgaattaatcatggcacagtgttcatctctctggaaatgcccacgccagcccagacacagcctcagagtcctttccaacacgaccctccaggcagcagttaccaaccatcagtcttcagctgaagcttcaagtctttgccatccttgtaatgacagccttaggccttgccccaagcattctggactctctaacactcagaattgtaatgtaatattctgctctaatttaaatttttaaaaatatagtctcctaattcaggataaggagtaagcaaactttctgaaaagggctagataataagtattttaggctttgccagtcatatggtctcttttgcagctactcaactctgccactgtagtatgaaagcagccatgagtaatatgttaatgaatgggaatggctgagttccaataaagctttatttttttttatttgagacggggtcttgctctgttgcccaggctggagtgcaatggcgcaatctcagctcactgcaagctctgcctcctgggttcaagccattctcctgcctcagccccccaagtagctgcgactacaggtgcgcaccacaatgcctggctaattttttgtatttttagtagagacagagtttcaccatgttggccaggttggtctcaaactcctgacttcgtgatccacccaccttggcctcccaaagcactgggattacaggcatgagccaccattcccagccaataaaactttatttacaagaacagctggtgggccagatttggcccaagggtcatagtttattatcccttgagctaggctgctgcctgaggttgattcaacatcccagctccagtcaacaacaaaaattctaagtctcccgcctaatgctgctgtggtgtgtcatgccaagaaagtgggctactcaggttagaccaatgacttcagaaccacagggctcagaacaggaaggagcttctttctgcagagctgattcctggaaagccaccagcactccaccttctgcccagaaatgtgattcagtcaatagctgatgaggaaaagcaacctgcaaacattaggaagaaggagaaaaataattcagaggtgatgataccacctccaatgaacagggaagcaagttcatcagtaacaaaagtcagtgaggc

SEQ ID NO: 1050 - DNA, 3014 bp, Homo sapiens
aagctcgggctccggcacgtagttgggaaacttgcgggtcctagaagtcgcctccccgccttgccggccgcccttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaaggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcaacaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgaccatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaagttctgtcaacagattcagtccccagtcctccttctctgagcagacctctcatccgcagcatatatctgctagatcttctaagagctgaaatggagacttctggaagaaggtgggaaagaaatccatctcggcttaattaaccatttatcgcatcatattactcccatcttaaaagtgcacgcgttgtttttctgaaccctcacacaaaggctactactgtggtcccatatctgtcggcccatgagaaacagtgttcttggacctcacagccaagcagcactgaactgcagcaaaatccagcaacacattcagcagcgagcagcctgctgagctccactggtttatccggggccaccaaccccaaagaactgggatgaaagcagatgtgagagaggaaaaggatctgtttttgttttattttctaccaggcccagctctttgtggggggaataaaaaagaagaaaaatcgagctccaagctggtgccctgccaagcttcctcccctcccttcctagtccaagcactccaccgtctgtgcagactgcataacagcaatttctggaaacaggctgaagaatctgggccagtccagaggcagtggattcctggtttatgtgtggtggggtttttaggaattttatttttcaccttaattctttcaacaactgccagctgtttgaagcacatctgtaataaacagcttctgtttgtaaaatgagactgaagttatcctctccagagaaattcctgaatcttctctgtagttcaatgccttcactgacagtttggctcaaaaagtatgagtgtggtaaatattaaagaatgttaatacaagtgt

SEQ ID NO: 1051 - DNA, 2436 bp, Homo sapiens
atacaacaacgtccaagcatgcaatttgtaggtttgctggctactgatgctggttactctgaattcctcacaggcgaaggacatttgaaggtgtctggggaagccaatgaaactcagattgcagaagcactgaagcgttacagtgaacgggcattctttgttcgggaagctctatttcatctttttagtctgactcatgtgatggaaaaaacaaagccagaaattttaaagcttgtggttactgggatgagaaaccaccctatgaatttgccagtgcaactggctgcaagcgcctgtgtatttaacttaaccaagcaggatcttgctgcaggaatgcctgtccgactcctggctgatgtgacccatttgctgctcaaagccatggaacattttcccaatcaccagcagttacagaagaattgcctcctttcactttgcagtgaccggatccttcaagatgttccatttaacaggtttgaagcagccaagcttgtcatgcagtggctttgcaaccatgaggatcaaaacatgcaaaggatggcagttgctatcatttctatcctggctgccaagctttctacagaacaaactgcacagcttggtactgagctcttcattgtcaggcaacttcttcaaatagtgaagcagaaaaccaatcaaaattcagtggacactacattgaaatttactttgagtgcactttggaacctcacagatgaatctccaaccacttgtagacactttattgaaaaccaagggttagaactcttcatgagggttctagagtctttcccaactgagtcatccattcagcagaaagttctaggacttttgaacaatatagctgaagtacaagaattacattctgaattaatgtggaaagattttatagaccacatcagtagtctcctacacagtgtggaagtggaagtcagttactttgcagctggaattattgcccatttaatatccagaggtgaacaagcttggacattgagtcgtagccagaggaattctctgctggatgatttgcattcagctattttgaaatggccaactccagagtgtgagatggtagcatacaggtcctttaatccatttttcccattacttggctgtttcacaacaccaggagttcagctatgggcagtttgggccatgcaacatgtctgcagcaagaatccttcaaggtattgcagcatgctgattgaagaaggaggattgcagcatttatacaacatcaaagatcatgaacatactgatccccatgtccaacagattgctgtggccattctggatagcttagaaaaacacattgtgcgccatgggaggccacctccctgtaaaaaacagccccaagccagactaaattgatagccataagtattggatagttgaatcacaggaatcctttttgtgattggtccatttggaatatcttaccctccctgatgttttgggggtttctatgacaagagtcataaaatcagtttgggattgataatgtgtagtactgcccatgtgaacagtctctaatttgtcttgtgattttaaacttatgagtcaagaagggtctcttcctttatcattgccttttaggaaattttccacatctttcagtgtttgaacttacttgtgcttgagattctacagttttatggtaaagtttgcacgaacccttaggccagacttttctgatctcagagtcccttccaatcaatttgcagcttcacataagctgttgacctgatttctgacactgcttcagttgtaaattttatactgcttctgtataaaatgcctttcttctctatctgtgtatattttataagatgtccttcttagtgtgaaagaagggaaatgtggatcatcttgtggaagctaatcactggcaggagcctggatggctggcggaaagatatatgagaaagaaaaattatgaaggtagaacagagtgtaggaactgggaattggtttcatggtataggttttaaaatgagacaggctacccttcgggagtccacctctcttgaggcggtgagcagaagcttgtcctccatatttatacctagaagtgtggactgctggttcctgcacagactgccggttattcactaggaatatttccccaagcaccacagtataaaatactacagcactctgtgttaaagactaactgtctacatctccatatgttgtagtgttgtggaaatgtgattttaaaaaattatcgccagttaaaactggctattcttttcctctatttcaaagtcatttttgttcagtggaatagagacagcaacatggtgttaacctctcaattaaaatacaattgacaccagtaaattttgccataaaaagttaaaatctcttgttcaaaatatgtgtatcttcttaatgtgttcatgttagagaaagtgtccccatctcactgcc

SEQ ID NO: 1052 - DNA, 2191 bp, Homo sapiens
caatgcacaggcaggctgggttaggccctgtggatccacagtggggacctagaggcaagtcagtttggtggggaaaagccagagttctaggtcatctattccctgcctggtttattttcaagccaaaactgagcagtctagctttctatgggatggagaagccaggtatccagcattggagactgatggagaatgagaggaagaaagagaggaggaccttgcagctgtggaaggctccttggagcctcctttgtgggagggtatcagttctggttctgccagagcctcagccctggtagcagaacctcagggctgcccctctccccaaactcctcccagcaaggctgaccctttgagctcactccttaaacagtattaaccctgccacactcatgggcattggcaccttggttcccctgccccactttgtcctgtgacaggtccattgctggcagtggacaggtgaaatactcactccagcctacttccggctctgactctcactcctcaaggggaagggtccgttagaaagtggcccaccccatggtacatggtctcttcttgaccacactaggactcttaggtagaaattagccttcccctttttatggatcattacaaagtgacggtatcacctgtggagagaatgtcctcttccctgctggctgccctgcccatactgtgcagggtgtggtggggtgcagggtgtggtggggtgggccacagttgtgtcctaggtctggagaaaagcttgcagactctgcctttggcaggattttctgcagttagccccgtccagagcagaacgaagggtatttcctagcctatttcctgggcaggctcctcaaatccagggatgaactactttctgcagtggccagccctccttttgattttattgtggccccaattccagggctttgggggttacagagaatcaggcttccggtgggagtagattgttttccatctataggtggagaaaattccaggaggagaatattgtctggcttccccgttctctctgggcaattgtttccttggttctctctccaactccatgttgtcttagtctcccagcaccccttcaggccttccatgtgggcccctagaccacactacccaccttcacacttgcattccacaactcagtccagtggccagcttgttgatgcctccataattctcagccagagcaaatccttgattggcccaccaggtcttgctgctccagaagttgccttgtgggcattccctggcaccatttcctctctgggtcctatactttcccaagtgcaggaggtcctgggggtatgcctgtgtgcctggcaacatccagcattgtgtttctgctccatctaggtgtcccatttctccagttgcccctcataaggcatcaaacctccagcaaaggaaggcaacagcccatggcctgaccacgggatctacaggttcagatctcaccagggatagcccagacttcaattcttgcttttttgggtatcagggccccaatcccttagtggccagggactcaaagtttggaataatcccagccctgccaagcattaagggtgctggtggggagtgtttgctggctgttcatgaacctctggtgtcctgggcctctctccactagacatggcagcatctctgagttacagattgcaatgtgttgccctgcatggttgaactgcttcggacatctgctaggcatcccatgtgccctgtcccctcttcaatgccagtgagtcacaatggcctatgcttattcacagcaataatacctagggagtccccatgaagcccttttgtcctggtccctcactctgcgtgggtctcctggggaggcagctgctgagtgggtcagttcatgagaacctgcatttatgaagccctgggctgtgtaggcatcaccctgggatgcagacaggttagaggcccagcccttaggggagccatggcagggagagtgccttccaccctgaggccacccagacctggaggagatgcaggccccagctctgctaaagggcctttgaggtgggtgggactgtctcccagttgggcagctcttgagaaggacacacgaccggtttgtgcgcccattgcctgctctgtgtctccgttggtccctctgtctcttccttttcacatttgtgcacataaaatatactggtgtttgtgttcc

SEQ ID NO: 1053 - DNA, 2530 bp, Homo sapiens
gatgcctgagatcagagtcacgcccttgggtgcctgccctgtgctgtcctggaacctggtccttccaccgggcagggggtcgagggcaccttccagcacagacaccaggacgggattccatgtcctcccccatggcgtgagcgcttcctcggagggtgccccccgccccggtgtggacactgtgctgtgaacacccctggcctgtgcacaccccatggcattttgcagctgtttgcatgggccccactgccctcccctgctctctgggtcctccgtggggtcctcccagcctgcccctttcccatttggcctcttggctgcctgttctgcccactctctggacatctgatctttctgatctttcatgtggcttcaattacccgcaatctgtacctgggtatattctcaaggtcacctcagccaaggcagcccctcggctgtggccccgtcatcctgatgtgtggtgctggctttggacacttcgagtggctggcagggggaggggccggccaggacgtgggccgaagctgcatcctggtctccattgcgggcaagaatgtcatgctggactgtggaatgcacatgggcttcaatgacgaccgacgcttccctgacttctcctacatcacccagaacggccgcctaacagacttcctggactgtgtgatcattagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtagatgatgagctggagatcaaggcctactatgcaggccacgtgctgggggcagccatgttccagattaaagtgggctcagagtctgtggtctacacgggtgattataacatgaccccagaccgacacttaggagctgcctggattgacaagtgccgccccaacctgctcatcacagagtccacgtacgccacgaccatccgtgactccaagcgctgccgggagcgagacttcctgaagaaagtccacgagaccgtggagcgtggtgggaaggtgctgatacctgtgttcgcgctgggccgcgcccaggagctctgcatcctcctggagaccttctgggagcgcatgaacctgaaggtgcccatctacttctccacggggctgaccgagaaggccaaccactactacaagctgttcatcccctggaccaaccagaagatccgcaagactttcgtgcagaggaacatgtttgagttcaagcacatcaaggccttcgaccgggcttttgctgacaacccaggaccgatggttgtgtttgccacgccaggaatgctgcacgctgggcagtccctgcagatcttccggaaatgggccggaaacgaaaagaacatggtcatcatgcccggctactgcgtgcagggcaccgtcggccacaagatcctcagcgggcagcggaagctcgagatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggtcaatggcgagacggtgacgctgcccacaagccccagcatccccgtaggcatctcgctggggctgctgaagcgggagatggcgcaggggctgctccctgaggccaagaagcctcggctcctgcacggcaccctgatcatgaaggacagcaacttccggctggtgtcctcagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctccaggccgccgccccttctgaggacccaggcaccaaggtgctgctggtctcctggacctaccaggacgaggagctggggagcttcctcacatctctgctgaagaagggcctcccccaggcccccagctgaggccggcaactcacccagccgccacctctgccctctcccagctggacagaccctgggcctgcacttcaggactgtgggtgccctgggtgaacagaccctgcaggtcccatccctggggacagaggccttgtgtcacctgcctgcccaggcagctgtttgcagctgaagaaacaaactggtctccaggctgtcttgcctttattcctggttagggcaggtggtcctagacagcagtttccagtaaaagctgaac

SEQ ID NO: 1054 - DNA, 2812 bp, Homo sapiens
agtcgcgggcaccccgctcggcgtcggtgcctgagggaggccgcgatggcggccgaggccctggcggcggaggccgtggcgtcgcgcctggagcggcaggaggaggacatccgctggctgtggtcggaggtcgagcgcctgagggacgagcagctgaacgcgccctacagctgccaggcggaggggccgtgcctcacgcgggaggtggcgcagctccgggccgagaactgcgacctgcgccaccgcctgtgcagcctgcggctgtgcctcgccgaggagcggagccgccaggccacgctggagagcgcggagctagaggcggcgcaggagggcggcgcacagcctcctcctagtcaaagccaagacaaggacatgaaaaagaagaaaatgaaggaaagcgaggctgacagcgaggtgaagcatcaaccaattttcataaaagaaagattgaagctttttgaaatactgaagaaagaccatcagctcttacttgccatttatggaaaaaagggggatacaagcaacatcatcacagtaagagcggctgatgggcaaacagtgcaaggggaagtctggaaaacaacgccttaccaagtggctgctgaaattagtcaggaactggctgaaagcacggtaatagccaaagtcaatggtgaactgtgggacctggactgcccattggaaggggactcttctctagagctgcttacatttgataatgagaaagttaacactgcaactaccaccgtgtacaggtgcggtccattaattgacctttgcaaaggtccacatgtaagacacactggaaaaattaaaaccatcaaaatttttaagaattcctcaacatattgggagggcaatccggaaatggaaacattgcagaggatctatggaatatcctttcctgataacaagatgatgagagactgggaaaagttccaagaggaagcaaagaaccgagatcacaggaagatcgggaaggaacaagaacttttctttttccacgatttgagtcctggaagctgttttttccttcccagaggagccttcatttataatacgcttacagatttcatacgagaggaatatcacaaacgggacttcacggaggtgctctctcccaatatgtacaacagtaaactctgggaagcctcaggccactggcagcattacagcgagaacatgtttacctttgagattgaaaaggacacttttgccctcaaacccatgaattgtccagggcactgtctaatgtttgcccatcgtccacgatcttggagggaaatgcctattagatttgctgattttggagttctgcatagaaatgaactgtcggggactctcagtggcttgaccagagtgaggcgcttccagcaggacgatgctcacattttttgcacagtggagcagattgaagaagaaataaaggggtgtttgcagtttttgcaatctgtttactcaacatttggcttctcctttcaattaaacctgtcaacaaggccggaaaacttcctaggagagattgagatgtggaatgaggctgagaagcaactgcagaacagcttgatggactttggagaaccgtggaaaatgaacccaggagatggagcattttatggccctaaaattgacataaaaatcaaggatgctattggcagataccatcaatgtgctacaattcagctggacttccaactgcctattagatttaatctcacatatgttagtaaggatggggatgataagaagagacctgtgatcattcatcgagccattttgggatcagtggaaagaatgatagccattctttcagaaaactatggcggaaaatggcctttctggctatctcctcgtcaggtgatggtcatccctgtggggccaacttgtgaaaaatatgcacttcaggtatccagtgaattttttgaagaaggatttatggctgacgttgacttggatcacagttgtacactaaataagaaaatacgaaatgcacagctggctcagtataattttattttggtggttggagaaaaggaaaagatagataatgctgtaaacgtgcgaacaagagacaacaaaattcatggagagattttagtaacttctgccattgataaactgaagaatctcaggaagacacggacactcaatgctgaggaggccttttgaagtccttccctgatatttgcttctgtgtaactttgttttgacccttaaaaatgtatttttcttaacatgttagtacttctacgactttggagccactgatgggtccactcatggcctcagctgagaaaggagacgatgaacgtgtagctgacatgcacgaagtttaatttactcatgtccacgggggacgtttagagggcacgtgggaaattttccagcaatcaatgccttgagaaacttaaatggggaaatattgttcatcgagaaagtgaaacaaaacactaggaaatgattatgaaatgttagtgattttcaaaagatgggcttcaaataaaagtctgcagagtttttttttaaataggagggaaaatcttattttctaatatgtctcaggtatttttatgacttctactaaaattcacactgaaactttatcttctaaactggaatcattacttaattttaactaaccaacaaccacaaaagcagcagctactgctaaatattggattactgacaaaggaattcagttttgtggaatctggtgtttgcactataggttaagagttgccatttaaatgtttcttattcataattaggttttgttccgctttagaaaaaaataaattcccaaatgaattgc

SEQ ID NO: 1055 - DNA, 2956 bp, Homo sapiens
ctcagtgaggctgatgccgtgcagcaagcagtaggtaatgagtctttgtgcagagtgaagctcttgttgctgaacaataaagcatatggtacaagcaataaaacacagggctgggaaatttaagaagattcctctgaaccaggaagaactgtgtcttcggtgatgctgacacatatgataaaatgatcatttattttggatcctaatgaataaagagtgcaaggactaagactacagttatttgaacaggtacatgtgacagcactgcagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaagatgactaagaatggcacagtagaatcagaagaagccagcactcttacactggatgacatttctgatgatgacattgacctggacaacacagaggtagatgagtacttcttcctacaacctttgccaacaaaaaaacgaagagctctgctgcgtgcctctggagtgaaaaagattgacgtggaagaaaagcacgaactccgagccatccgcctctcacgagaggactgtggctgtgactgccgagtgttctgtgatccagacacgtgcacctgcagcctggctggcattaagtgccaggtggatcgtatgtctttcccatgcggctgcactaaagaaggatgtagtaacacagcaggtagaattgaatttaatcctatccgtgttcggactcactttttgcacacaataatgaaacttgaactggagaaaaaccgagagcagcaaatccccacgctgaatggctgccacagtgagataagtgctcacagtagttctatgggccctgtcgctcactccgtagaatattcaatcgcagacagttttgagattgaaactgagccccaggctgcagtgctgcacctgcagtcggctgaagaattagattgccaaggagaggaggaggaagaagaggaggatgggagcagcttttgcagcggagtcacagattctagcacgcaaagcttggcacctagtgagtcagacgaggaggaggaggaagaagaagaggaagaggaggaggaggatgacgatgatgacaaaggagatggcttcgtggaaggtttgggcacccatgccgaagttgtccctcttccttcagttctttgttattctgatggcaccgccgttcacgaaagccatgcaaagaatgcttctttttatgccaactcttcaactctgtattaccaaatagatagccacattccaggaactccaaatcagatctctgagaactattctgaaagagacactgtcaaaaatggtaccctttcgctggtgccttacactatgaccccggagcaattcgttgactatgcccgacaagcagaagaggcctatggtgcctcccactacccagctgccaacccctctgtaatcgtttgctgctcctcttccgaaaatgatagcggtgtgccctgcaatagtttatatcctgaacacaggtccaatcaccctcaagtggaatttcactcatacttgaaaggcccctcccaagaagggtttgtctctgcattgaatggtgacagtcacatttcagagcatcctgctgaaaattctttgagccttgcagaaaagagcatattgcatgaagagtgcatcaaatcacccgtggttgagacagtccctgtttagtagcttaaattattctaggaccaactcttctcttatttaaggcactgtatttaattggatttcctgggctcatcattgtttaaactgaagaccaagaaaacttggacggtggttaatcttccagactgtattttgttttttcctttctagccacatgactgtggcattgcacaaatacagtctctgtagggattttaaaagatttcagactgttttgatagaaaaagctaaattttaaaatgcatatctcacagttgcctacctgtcaaactgtgtgaaacctgccaatctgtgtagatcagagctccaaattttggattatcgggcctgtgcaagattgttaactaaggctgggaaataataagatttagagtcctaattttcaatatatctgaagataatgatgactttttaatgtaaaagtaattattgtaagaaaaagatttaattgttccatgtgtattttatttatggtagtttagaagacatgttttgatgaaaatgaacagccgcatgttcattcaagctgaagatgcatagctagttccacagagcatgcccacatggattgcatctggaatccattcacatttttatgatcatgactgatcagatttgcaaattcttaagggtgaaataggcctatttttgctattttggacaaataaatgattctatatgtgcaggtccttacacagttttctctaaagttaagagttaggacaatcctctggggagagtctagttcactgccctccctcagctgactccagagatggaggtagaaggaattgcctttcttttttaaacagcatcatcttgattcttagcttggacagcacctttaagctctaccccctacatcaaaatgcactttagtgccccttcacggtacctcgtgtggggtggggactgagaactctttg

SEQ ID NO: 1056 - DNA, 2427 bp, Homo sapiens
acattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctggatgaagttttgctcttgttgcccaggctggagtgcaatggcgcaatctcggctcactgcaacctctacctcccgggttcaagcaattctcctgcctcagcctcccaagtagctgggattataggcatgcgccaccacgcccagctaattttgtatttttagtagacatgggtttcaccatgtgggccagactggtctcgaactcctgacctcaggtgatccaggcgcctcggcctcccaaagttctgggattacaggcatgagccactgcgcccggcctaagcttctaatttcaagatgtcatcagacagcagggggatagtggagtcaaacctgccaactctaccccctcccgcacactccccaccaacgcactctcagctgcagttgcctagggcaaaggctctgcaggtgcagactcctagagagccctggacaattcagaaagagcccctgaggggagaagcctagtcctgtagtcagaggctttctgaattcccagagctgcacggctcagccaaagaccagaaaagcctctgaccacagccagaaggccctgccttgtttgctaaggccgccccagccatggggctgaggaagaggagagggcatacctgagtctgggcgcccattcccagaggccacgcagaagccgaaagtgccccctggggagcgctgcagctgcagctggctggtgccgtctgggaacacctccaccaggcggcccacggtgcgagccaggctgggagcacccacgtcctccacactgagggcacgccgtggtgaagtcttggccggcctgcgagggaaccagagacacagtgagggcaaaaagcatcaggcactgggcacagctcttccctggcttacagatgaccgatgcctcacagacttaagagcctggcattggaggctggggttctgctgacttcaaccagcaaaaagagcctgctagggccaaaactggtgggtttccgccgctgtgcaaggccccccaaggcctgctgtggaactagaaaccccaccctcccaaagcagtggtttcaaattttggggggtacagagacctttgtaagaatctgacaaaaggtataactttatgtcacatttccaggagctaacatacaccctgaagtacatccacgccccaggaaagagcagccagcctacagggcctcatcggacagggtgggattttccaagcaggtcacgggtcacgggcctctttgggggcctctgtctctatgtgtttattcagatctttagctgggctaagaaaactctctaaactttctgatttcaagatgtcattgcacagcagagggacagtggaatcaaaccggccaactctaccccctccagcaaccccaggccttctcagagcccaatgcaccgagggtccatgcagggcactgaggtgctgagactcccgtggcagcctcgtctccacacatcacatgtcctgttgctttcccttcaaaggaccctgctcagagccatgatgctgaggcaggaaggagttaagcttttggctccgctggtcactctctgagtttatcctccaaaccatgtgtgcccctcatacctgccagctgcactgtggtcccctggccctgctaccaggtagaggctggaccggtcccccttgctgctcagcagagaatggaggttctgaaaagaggcagctttccgacgctggtgagagggtgacacctgatgagaaagggacaatattgcgggtgagaaaagctacctgggaggtgctgacagaggacttggccccaccatgaacctgagggccctgtaagaaagtgacagcacaagcttttatcattgcttccaagaattcaacaggaaccaccatgacttactcaaggacatcatgggtctacataggccatctgaggagtcaagggagtttttgttttgctttttagctgaaataacaactttagtgctatactaatttcctcattgattaaggaaatctaatgtactcattaaggaagaaatgaaagtaagtttattatacagtaataaataccactttagagttaaaattc

SEQ ID NO: 1057 - DNA, 3015 bp, Homo sapiens
gagcccgcgctcggcccgcaggacgtggagaccacgtacttctgcaacacgtgcggacagcccctatgcgcgcgctgccgcgacgagacgcaccgagcacgcatgttcgcgcgccacgacatcgtggccctgggtcagcgaagccgcgacgtgccccagaagtgcagccgtgaaggccctgcagacggccacgcgggaggccatcgcgctgctgcaggccatggtggaggaggtgcggcacagcgccgccgaggaggaggacgctatccacgccctcttcggcagcatgcaggacaggctggcagagaggaaagcgctgctgctgcaggctgtgcagagccaatacgaagagaaggacaaggccttcaaggagcagctctctcacttggccaccttgctgcccaccctgcaggtccacctggtcatctgctcctccttcctcagcttggccaacaaggctgagctcctggacctgggctatgctggcagggggcttaggccccaaggcgctgacggggccccactgcccctccccagtaggaaagatgtcggggtcacccgtccaaaagcccacgctgcaccggtccatcagcaccaaggtgctgctggcggagggcgagaacacgcccttcgcagagcactgccgccactatgaggactcctaccggcctctctgtgcagcacctgcaggcagagatgcagagcctaaaggaccaggtacaggagctgcaccgagacctcaccaagcaccactcgctcatcaaggcggagatcatgggagacgtcctgcacaagtccctgcaactggacgtgcagatcgcctcggagcacgcctccttagagggcatgagggtcgtcttccaggagatttgggaggaagcctatcagcgagtggctaatgagcaggagatttatgaaggttccagacagttggctgccgagtgaaccctctgtccctgagctaacccacatactagcagaggaggaagtcagagtcggccactaaccagatgcaaatccccacactcttccccttagcgcttgaccgtgcctcccagctgctaactggcctcaaatgatgcatgtgaggtcaggattcattgagtagaatgcccccaccaagtgcctccctctttaattagaggtcatcatggaaatggtcgggatatttacgtggtgcctggcttgagtaaaaatctgaagccagatgcttcaggattaagaccccatgctctggccttggccccacagcccagctccatgaccttctccagctgaggcaggagaatgcctacctgaccaccatcaccaagcagatcacgccctacgtccgctccattgccaaggtgaaggagcggctggagcccaggtttcaggcacccgtggatgagcagtcagagagtctacagaacacgcacgacgacagcaggaacaacgcggcctcagccaggaataatccaggaagtgtcccggaaaagagagagaagacatcagagcctaaaggaaacagctgggctccgaacggcctctcagaagagcctctactgaaaaatatggatcatcacagatccaaacagaaaaatgggggcgatgtccccacatggagggaacacccgacttagcaaatgggaccggtccccagggtcaggctcttagagcaggcacaagactgggacactggacagaaggttgttcccatgatggttttttctattttttatttttgagatggagtttcgctctgttgcccaggctggagtgtaatggtgcaatctcggctcactgcaacctctgcctcctgggttcaagcgattctcctgcctcagcctcccgagtagctgggattacaggcgcctgacaccacgccccgctaattttttgtatttttagtagagatggggtttcaccatgttggccaggctggtctcaaacgccagacctcaggtgatccacctgcctcagcctcccaaagtgctgagattacaggggtgagtcaccgcgcctggccaatgttgttgttgtttttaagacagaatttcactctttgttgcccaggctggagtgcaatggcgcaatctctggctcaccgcaacctccgcctcccaggttcaagcgattctcctacctcagcccccagagtagctgggattacaggcatgtaccatcacacccggctaattttttgtattttaagtagagagggggtttctccatgttggtcaggctggcctcgaactcccaacctcaggtgatccgcccacctcggcctcccaaaatgctgggattacaggggtaagccactgtgcccggccggttatttctttaaaaggtaatcatttgtcaagagtaaaacccagaagctctgacaggccataatttcagatcctttggcttgggcagttttgattttccccgtgtttgcatggcatgaagtcttcgtccttgtcacggtagcttgggatgactcccagtccacatggaaaacatcagggagtgacaatccagcaagaaatccctcgctagttccacacctacgcaccgagcgtcggtgtgccaggccctgtgctgggcagagtgtggtatgtcagggtgtgccggttttaggtaacaagactccaccactgagtggcacctgccctattgcaaaggaatccagttcctccggaataacagtcccactgttaacctggtgctactgggaagttccacacagtaatctgagcagtgactcatggaaggatgaggaacgtttgctccagcttctctccctttccagcaagggcagagctcctaaagccaggggttagcacctggccagcttatgtggcagatggtctcagttacaacttcgctgctttcccaaactcctgcagccctcctgagtccgacttccgttgatagcaaggcactgggtggcagcaaccttttttctagtagtttttttcccagcagttttccatttctccacagtatccttttcatttagaggagcttaataaatgctttttaaaaagt

SEQ ID NO: 1058 - DNA, 2930 bp, Homo sapiens
atgcatgtgagaacccacaatggagagagaccctatgtgtgtaaattatgtgggaaaacctttcctcgtacttcctccctcaatcggcatgtaaggattcacactgctgagaaaacctacgaatgtaagcaatgtgggaaagcctttattgacttctcaagtcttactagtcatctcagaagtcacaccggagagaagccatataagtgtaaggaatgtgggaaagctttcagttattcctcaacgtttcgaagacacacaataacacacactggcgagaagccatataaatgtaaggaatgtgcggaagcctttagttattcctcaacttttcgaagacatatgatttcacacactggagagaagccacataaatgtaaagaatgtggggaggccttcagttattcttcggcttttcgaagacacatgataacacacactggagagaaaccctacgaatgcaaacaatgtgggaaaaccttcatttatctccagtcctttcgaagacatgaaaggattcacactggagagaaaccctacgaatgcaaacagtgtgggaagaccttcatttatccccagtcctttcgaagacatgaaaggactcatggtggagagaaaccctatgaatgcaaccagtgcgggaaagcattcagtcacccctcctcctttcgaggacacatgagggtgcacactggagagaaaccctatgagtgcaagcaatgtgggaaaactttcaattggcccatatctttacgaaaacatatgagaacacatactagagagaaaccctatgaatgtaagcagtgtgggaaagccttcagcttgtctgcttgctttcgagaacatgtgagaatgcaccctgaagacaaatcctatgaatgcaagctatgtgggaaagctttctattgccacatatccttacaaaaacatatgagaaggcataccgcagagaaactctataaatgcaagcagtgtgggaaagctttcagttggcctgaacttttgcaacaacatgtgagaacgcacactgtagagaagccctatgaatgtaaggaatgtgggaaggtcttcaaatggccatcatctttaccaatacatatgagactgcacactggagagaaaccttatcaatgtaagcattgtgggaaagcattcaattgttcctcatccttaaggcgacatgtgagaatacacactacagaaaaacagtataagtgtaatgtaggacatcctcctgcaaatgaattcatgtgcagtgcttcagaaaagtcacaccaggagagagatctgatcaaagttgtaaatatggtgttgcctttatgagttccttatcctgaaagtggacactcaaggagtgtgtctgtagttcatttgcaaataaacatttagttgaaaaataattctccaaatactctcagctatcctacatgaatttgaacaggtagtttcttacgattcagtaaataaaactttcatcttagagtgttttggactcatggatgatttgaagtgtatttttaatatgcaagtaggttcaagttttatttaatttcttaaattgtaactgacttagtgtgacaggtattggatattacgtatctattatattttccaccttttttactgggagtatttttattgtttggccagaggagccttattccattttttaagaagtagttggcagaattttgtaattatgcaaagttgtttaaggagtatagcctcaaatgaattgtaatttttaatgtttgcccattgctgtttgtctttgcttgtgattgtgaattggacagtaggctttgacttgtgatgtgacggagaaatccagagttgcagatagttcttctgcattgttgtcagtgtgggtagtgttaggaacttcatttgctggaatgcatttcctttatggttccatgtccaaatttaccaatagcaataacttgaatgaaatttagaatgaagaagaagtaagtcatcgctgagcttttggggtcacattaaatggagatggacagatgcataggggctttgtgaacatcaaccttcagcttattttccagattcttattcctgccaatcaagagtaccatcaaaagaaacacttaagtgcttgatttccactgtgtcagaggtgtagtcttcctcagacatctccattaacttgatattagggatattcctgtgtggtcagtcacctagagtctggatttttctcaaaaccctgcatgacctcttgaccactgattcagactgtcttgtttggcagtctctgagcttctgattctcccgttctgtagatcttaacatatttgcatggggtctaatttatatagtgaacaccttgttatcttaatacttccagtggctctgtgatcctgattccaccacgaaagccacagtgttgcagtcaaagaagaaaaacaacacatgggactttgtaccctattgcatttttaagtgtgcctgccgagtcctatgtgagaacaaataccttcctcatatattagatttagggagatttctgttactcagaactaaatgcagtttcttgatataggttaaattattaggtttgattatgtatcattaaaaataatgtggattttgtttcaaggaaaaccttctgtagatatttcttagaaatatcctgtttagctgggcacagtggctcatgcctgtaatccctgcactttgggaggcttgaggtcaggagtttgagaccagcctggttaacatggtgaaaccctgtctctactaaaaacacaaaaattagccaggcatggtggtgagtacctgtagccccagctacttgggaggctgagacaggagaagtgcttgggcctgggaggcggaggttgcagtgagccaagatcacaccactgcactccagcctgggagacggggaaagactccatcacacaagcaag

SEQ ID NO: 1059 - DNA, 2823 bp, Homo sapiens
acattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaagggaaggcagctatagtagtctttcccctccaaccttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagactcattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagcgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaatt

SEQ ID NO: 1060 - DNA, 3731 bp, Homo sapiens
agtgggtgcggtcacgtgggccggcggtccagggccggaatggcagcaagctcagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttgttcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctttaatatttggaaaagatcagaatcaagctttgcgactctgtctgggtagcactagtgttggaggtcagtatggcgctatctctgccctcagtatcaacaatgattgctcaagacttctttgtggctttgctaaaggacagatcaccatgtgggatttggccagtggaaaacttctaagatcaataacagatgctcatcctccaggaacagcaatattgcatatcaagtttacagatgatccaactcttgcaatttgcaacgacagcggaggctctgtttttgaattgacatttaagagagtgatgggagtgagaacctgtgaatctagatgtctgttcagtggttccaagggtgaagtctgctgtattgagcctctgcattctaagcctgagttgaaagatcatcccatcacacagttttcattattggccatggcatccttgacaaaaatactggtcattggattgaaaccatccttgaaagtatggatgacttttccctatggccggatggatccttccagtgtgccactgctggcctggcactttgtagcagtacaaaattatgtgaatcccatgcttgccttctgcagaggagatgttgttcattttctattggtaaagagagatgaatctggagcaatacatgttactaagcaaaagcatcttcacctatactatgacctcatcaactttacctggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggctttggttggagagaaggcttgttatcaatccatcagtagctatggtggtcagatcttttatttggggacaaaatctgtttatgtgatgatgctgaggagctggagagagagagtggatcatctcctgaaacaagattgtcttacagaagcgttggctcttgcgtggtctttccatgaaggaaaagcaaaagcagtagtgggattatcaggggatgccagtaagcgaaaggctattgttgcagaccggatggtagaaatcctattccattatgcagatcgagctctgaaaaagtgcccagaccaaggaaaaatccaagtgatggagcagcattttcaggatatggtgcctgtcatagttgattactgccttctgctgcagcgaaaggatcttttatttagtcagatgtatgataaattaagtgagaattcagtggccaaaggagtatttttggagtgccttgagccatatattttaagtgataaattggtgggaatcacaccccaagtaatgaaagacttgattgttcatttccaagataaaaaattaatggaaaatgtggaagcgctcattgtacatatggatatcaccagcctagatattcagcaggtagttctcatgtgttgggaaaatcgtttatatgatgctatgatctatgtctacaacagaggcatgaatgaatttattagtccaatggagaaacttttcagagtcattgctcctcctctgaatgcaggaaaaacactaacagatgaacaagttgttatgggcaataagctccttgtatatattagctgttgtctagcaggtcgtgcctatccccttggtgacatccctgaagatctggttcccttggttaaaaaccaggtttttgaatttctaattcgcctgcattcagcagaggcttctcctgaggaagaaatctatccttacattcggactttgctacattttgacacaagagaatttctaaatgtattggcactgacttttgaagattttaaaaatgacaagcaagctgtggaatatcaacagcgaattgtggatattttgttgaaagttatggtggagaattcagactttaccccctcacaagtaggatgtctctttaccttccttgctcggcagcttgcaaagcctgacaacaccttgtttgtaaacagaacactttttgatcaggtccttgaattcctttgtagtcctgacgatgactcccgacactctgaaagacagcaggtccttttagaattgctgcaggctggaggcatagttcaatttgaagagagtcgactcatccggatggcagaaaaagctgagttctatcaaatttgtgaatttatgtatgaaagagaacaccaatatgacaaaattattgattgctacttacgtgaccctctgcgagaggaagaagtctttaattacattcacaatatcttatccattcccggacacagtgcagaggagaagcagtctgtatggcagaaagcaatggatcatattgaggaactcgtgtccctgaagccttgtaaagctgcggagctggttgccacccacttttctggacatattgaaacggtcattaaaaaacttcagaaccaggttttgcttttcaaatttttgaggagtcttcttgacccaagggaaggtattcatgtaaatcaagaattactgcaaatatctccttgtatcacagagcagttcattgagctgttgtgtcagttcaacccaacccaagttatagagactctgcaagtccttgagtgctaccgtctggaagaaactattcagattactcagaagtatcaacttcatgaagtcaccgcttatctattggaaaagaaaggagatattcatggtgccttcctaataatgttagagagactacaaagcaaacttcaagaggtaacacatcaaggtgaaaataccaaagaggatccctcattgaaggatgttgaagatactatggtggagaccattgctctttgccagagaaattcacataatttgaaccagcagcaacgtgaggccctttggtttccgttattggaggcaatgatggcccctcagaagctgtccagttcagccattcctcatctacactctgaagctctgaagtctttgaccatgcaagttttaaatagcatggcagcatttattgccctttctaacaataaatgctccgtgtttaagttc

SEQ ID NO: 1061 - DNA, 3521 bp, Homo sapiens
atcgcagcgagagcgtttttgcctgtggagagccggccgacgggagccgcggcggagcctgttgagctcgcgcgggctgccgggagtggtctctgaggcggcggcggcggcggggatcgtctccggcactggcgcaccatgtcggtcagtgtccatgagacccgcaagtcgcggagcagcacggggtccatgaacgtcaccctcttccacaaggcctcccacccggactgtgtgctggccgcctctagccgctattttgaggccatgttcagccatggccttcgggagagccgggatgacactgtcaacttccaggacaacctgcacccggaggtgctggagctgctgctggactttgcctactcctcacgcatcgccatcaacgaggagaacgctgagtcactgctggaggcaggcgacatgctgcagttccaggatgtgcgggatgctgccgccgagttcctggagaagaaccttttcccctccaactgcctgggcatgatgctgctctcggacgcccaccagtgccgccggctgtatgagttctcctggcgcatgtgcctggtgcactttgagacggtgaggcagagcgaggacttcaacagcctgtccaaggacacactgctggacctcatctcgagtgatgagctggagaccgaggacgagcgggtggtcttcgaggccatcctccagtgggtgaagcacgacctggagccacggaaggtccacttgcccgagctcctccgcagcgtgcgtctggccttgctgccgtccgactgcctgcaggaggccgtctccagcgaggccctcctcatggcagacgagcgcaccaagcttatcatggatgaggccctgcgctgcaagaccaggatcctgcagaatgatggcgtggtcaccagcccctgtgcccggccacgcaaggcgggccacacgctactcatcctggggggccagaccttcatgtgtgacaagatctaccaggtggaccacaaggccaaggagatcatccccaaggccgacctgcccagcccccggaaggagttcagcgcctcagcgatcggctgcaaggtctatgtgacggggggcaggggctccgagaacggggtctccaaggatgtctgggtgtacgacaccgtacatgaggaatggtccaaggcggcgcccatgctgattgcccgctttggccatggctcagctgagctggagaactgcctctatgtggtggggggacacacatccctggcaggggtcttcccggcctcgccttctgtctccctgaaacaagtggagaaatacgaccctggggccaacaagtggatgatggtggcccccttgcgggatggcgtcagcaatgccgcagtggtgagtgccaagctgaagctctttgttttcggaggaaccagcatccaccgggacatggtgtccaaggtccagtgctatgacccctcggagaacaggtggacgatcaaggccgagtgcccccagccttggcggtacacagccgctgccgtcctgggcagccagatcttcatcatgggaggtgacacggaattcacagccgcctcggcctaccgctttgactgtgagaccaaccagtggacgcggattggggacatgactgccaagcgcatgtcctgccatgccctggcttccggcaacaagctctatgtggtcgggggctactttgggacccagaggtgtaagactctggactgctatgaccccacttcagatacatggaactgcatcaccacagtgccctactcacttatccccacggcctttgtcagcacctggaagcacctgcccgcgtgaggagcacctgctgagcccagccagaccgcggccttcagtgtcacagcgtggccttgcttgtctgccacagcgggagctaagccggccctgggccagcactccgagaggtggaaggggccctgccagctctggggagcagcagccttgggctgttctgagctttaggcaagagaagagaagcatctcttgcatccgtgcccctgggggcctcttcagctttgcagtggtttgtgggaagacatacctcccagaggggcatggactgccaccaggactgaccctggcgtcggggagaaggacacttgcagagccttgagatcacctgtttggcaggtcctggactggggccgggcaggcaggggcagggaggcgccccgggtgggctttggggctgcggcactgccacacatcctttccctcctggcctgccctgctggggctctactgccatctatagatggtgtcctgggcctgggaaactaggttcccaggggttgagaccagaaaggtgaccaaggcagattttttaaggtgcagaaactgcaggggggcctcagtgacatccatgaggccttattagcaaaggacatccagacctccaaggtttgtgggccccttccacaaagctgtaagtcccagcccacctactcagggccttgctcagtgctgtggcccggtggggacacagttgctcgtggccactcagtggagctgggcctgcagcagactcaaggctccgagtgccctgggggtcacccctcccctcccctcctcagagcccaccctgagaggcagcagtgacccccatggcacacacctgccaacagcactgggggcttctccccaggagaccacgctgtcctccaagaccaggagcagctgtgagctggagacagcagagggaccccagggtgtcccctgcagatcccaccagggccgcatccatctcagtgtggaggacagtgacgggaccctcaccatcctcttgcgttttggcccccatttgctccctgagctccaagataagaatggccccgagagaactgctgaacatttgttcattgctgtcacctcctgagtcactggggtccctcaccagcacctccctgacacctgggctatggagaggttggcgcctgtcagtgaccatcctaatgcctctcgctcactcccaagccaccatttgagagggaggggtgttggtgccctgacagggactgggcagggtgtccaaacttggggcttcccaggcacctgcagtgtgaacactgcttggctggctcaagattagggccgcggagggggctgtgcacataccagttacttaagcagccacgagtgtcccccatgccttggtgcgggtcctggaggcctcttgggggtgggacctttgggcagggtttgcccactgacacgcccgccatggggcactggctgcatggggctccttggaccctgtagacccagcagaccccgcctgtgtcaggccagctgcccgaaggcacttggctgtggtcccaggggacggccctgctggcacactcaggagcctggccgcggggactgcagggagggtgcctggacccgtggggttgcttcattgagataaagcacacttatcacatagcacaaaggacgtgccatggtgctttccccaaaagttgtgttgcttttatcagttttctaacttaataaaaagggttgag

SEQ ID NO: 1062 - DNA, 2863 bp, Homo sapiens
agaaaaacggggagcaggagccagactaggggaggaagaggactggcccgctcagggaatagctgggttgctgcaaaaaggggcggggagaaggcgggggcgctgcatgcagcgcgctggctccagcggtggccgcggggaatgtgacatcagcggctccgggcgcttggggctggaggaggcagctcgcctcagctgcgctgtgcacacctcgcccgggggaggacgcagacccgggcaggcggcagggatgtcggcgaaggagaggccaaagggcaaagtgatcaaggacagcgtcaccctcctgccctgcttttatttcgtcgagttgcctatattggcatcatcggtggttagcctctatttcctcgaactcacagatgtcttcaaacctgtgcactctggatttagctgctatgaccggagtcttagcatgccgtacattgaaccaacccaggaggcaattccattcctcatgttgcttagcttggcttttgctggacctgcaattacgattatggtaggagaaggaattctctactgttgcctctccaaaagaagaaatggggtcggactagagcccaacattaatgctggaggctgcaacttcaattccttcctcagacgagctgtcagattcgttggtgttcatgtatttggattatgctctacagctctcattacagatatcatacagctgtccacaggatatcaagcaccttactttctgactgtgtgcaaaccaaactatacctctctgaatgtatcttgcaaagaaaattcctacattgtggaagatatttgctcaggatctgacctcacagttatcaacagtggcagaaagtccttcccttctcaacatgcaacccttgctgcctttgcagctgtgtatgtttcgatgtacttcaattccacattaacggattcctctaagcttctgaaacctctcttggtcttcacatttatcatctgtggaataatctgcgggctaacacggataactcagtataagaaccacccagttgatgtctattgtggctttttaataggaggaggaattgcactgtacttgggcttgtatgctgtggggaatttcctgcccagtgatgagagtatgtttcagcacagagacgccctcaggtctctgacagacctcaatcaagatcccaaccgacttttatctgctaaaaatggtagcagcagtgatggaattgctcatacagaaggcatcctcaaccgaaaccacagagatgctagctctctgacaaatctcaaaagagcaaatgctgatgtggaaatcattactccacggagccccatggggaaggagaacatggttaccttcagcaataccttgccgcgagccaataccccatctgtagaagaccctgtcagaagaaatgcgagcattcatgcctctatggattccgctcgatcaaagcagctcctcacccagtggaagaataagaatgaaagtcgaaagttgtccttgcaagttatagagcctgagcctgggcagtcaccacccagatccatagaaatgaggtcaagctcagagccatcgagggtaggggtgaatggagaccaccatggtcctggcaatcagtacctcaaaatccagcctggcgctgtccccggatgtaacaacagcatgcctggagggccaagagtgtccattcagtcccgtcctgggtcctcacagttggtgcacatccctgaggagactcaggaaaacataagcacctcccccaaaagcagcagggtgtcctccaaagcagccccaagaacactgaaggcagcacggtctcctgcactggctccatccgctataaaaccttgacagaccatgagcccagtgggatagtgagggttgaggctcacccagagaacaacaggcccatcatacagatcccgtccactgaaggtgaaggcagtggctcctggaagtggaaagcccctgaaaagggcagccttcgccaaacttacgagctcaacgatctcaacagggactcagaaagctgtgagtctctgaaagacagctttggttctggagatcgcaagagaagcaacattgatagcaatgagcatcaccaccacggaattaccaccatccgcgtcaccccagtagagggcagcgaaattggctcagagacgctgtccatttcttcttcccgcgactccaccctgcggagaaagggcaatatcattctaatccctgaaagaagcaacagccccgaaaacactagaaatatcttctacaaaggaacctcccccacacgggcttataaggattgagtgatgtccattccatcattagggctacccgcaaaagaccatatgttgattctacctgtgttctgctgttagtacttccatcctcttccttcccaaagagcagaccccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacagcaaggactgccgcattggtgatggagggccagctgaggggaagttgctggtgagtttccttttctccatttctggcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagacttggttttag

SEQ ID NO: 1063 - DNA, 2777 bp, Homo sapiens
agtgctcttggccgggaggaggctgtgctgcaccagcacctcttgctccacatctccagagagcccagggccctgtggccgagtgtgtccagcccagtgtcatggggagcttccatatctcatggctccttgctgggccaagccctccagaaccccaaacccccaaagactgatgaatgccagagtggccaccttgcttatctgtggccccggccctggtgatcaccatggcagctgggaagggagccccgttgagcccatcggctgaaaacagatggcgacttagcgaacctgagctgggccggggctgcaagccagtgctgctcgagaagacgaaccgcctgggccctgaggctgctgtgggcagggcgggccgggatgtgggcagtgcggagctggcactgttggtagccccaggcaagccccgacctggcaagccgctgcccccgaagacacgtggagagcagaggcagagcgccttcacggagctgccgaggatgaaggaccggcaggtggatgctcaggcccaggagagggagcacgatgaccccacaggccaacctggtgccccacagctgacccagaacatccccagaggcccagctggcagcaaagtcttctctgtgtggcccagcggagcacgaagtgagcaaagaagcgcctttagcaaaccaaccaagcgaccagcagagaggcctgagctaacctcagtcttccctgcaggggaatctgcagatgccctgggggagctgtctggactcctcaacactacagacctcgcttgttggggtcgactttcaactcccaagcttttggttggtgatttgtggaacttgcaagcattgccacagaatgctccactctgtagcacttttctgggtgcccctacactgtggctggagcatacccaggcccaggtgcccccaccctcatcatcctccaccacttcgtgggccctcctgccacccaccctcacctccctgggcttgtccacccagaactggtgtgcaaagtgcaacctgtcctttcgcctaacgtccgacctggtctttcacatgcgatcccaccacaaaaaggagcatgcggggcctgacccacattctcagaagcggagagaagaggcccttgcctgccctgtgtgccaggagcacttccgggagcgccaccacctctcccggcacatgacttctcacagctagcaggtgaccgcagaatgacctgctgggtgcagcagccagcctttggcagaggggggctccctgggcctgcgttgagggggctgtcatggtcctttgcagagctgctgcttttggcattcatagataaacagctcaggcataatttgaaaaagccacacctgcatgatgtgttttgaaggaaatgaagtcctgaaataaagtgatgggctttgcaaatccagggtagaggccctaacaggcacagagagcaggggcaactcctggcacacatcatgggctttggaggcacacaagcctggattcgaatctgggctctttcacatactagctgtgaccctggacaaagagctttaacctgctgagtccccattttctcatctgtgaaatggagatgataacactgtgtcttaggttggcattcaggtcacatgaaaggtgtgtggaaagtggccagcattctgcctgcagaccctgagcactgagtcaacaaggtttgtgatgatgtctgtactagttagctattgttattaacaagatctccatggcagacaagctaaagcatctgcctaagtcgtgagtctgtgggttggctcaggttaagctgagcaggtggggatctcagccagcctcccagactgcacctcttctattgctctcctctgtccaccgttccaggcagcagcactcccacctggctgctctgatgtcctcgctccctccattcctgcctctcaccatgcacgcatccattgtccacacacacacaaccagataatcttctgaaagtgtaactcagatgatgcctccaaccctgtggctgcccttcacacttacaggcctaaccccagcaggacctgccagctgcttcatgaacaagtccctgcctcatgttaattgcaagcactcatttcactctccctgtgtgccaggcaatagcataagcactggaagaatacagatgttatagtgagtcctacaatagccctggaaggcaagagctgtttcctttccatttctacaatgagtcaattgcagatgatgctataacacttccagtgtttctgacacttccctgaagctatacctgctaccttcatgggccgagcttgcccttatgaggcccacaggtggcagtgggcagaggggaccccgctataccacctcgctgctgttccactgtctgctcccgtgttctgaccacagctctggtgccgtttctcaagcctgggcttcattcaacattttctatctagctcttcatggtgctgctcctgctatggttccacagggcttcttctcgcaggtcagctccttagagaggtctcccagattccccgtaaagcagccctgcagcctctgcctctctcagccgcatcaccctgttgcttccttcacagcatgtctcaccatctgcaaccatctttctgtttgtcgtcttgttgatttgctgcctccacactgtcagctccttgggaacagagattggtttgtttactgtgcatccctggtgcccagaacagggcatggcatattgttggtgcataataaatattgtggaaataaaaaaaaaaaaaaaag

SEQ ID NO: 1064 - DNA, 2999 bp, Homo sapiens
tacctggaacttcatcatcatctacttcacaggaattgccattttgtcaacctaagaaaaagtctacgccactgaagtatgaagttggagatctcatctgggcaaaattcaagagacgcccatggtggccctgcaggatttgttctgatccgttgattaacacacattcaaaaatgaaagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccagctgtgcggtcagagaagaaacgccttaggaagccaagcaagtggcttttggaatatacagaagaatatgatcagatattcgctcct

SEQ ID NO: 1065 - DNA, 2806 bp, Homo sapiens
atgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggtaagagtaccccatggatgggaggaaaccactctccaaggggtctaccactcatttgctgtgtggccttgggcacatgagttcccttctctgggcctgtttccttatctgcatgatggggaagttggcttagcttctcacctgggccctctcagccctttgcatggggagaaggtggagatgactataatcccgacacaaggcctttctgaggaaggcaaaaggcacctcgctggggttgttgtccagctttgctgctaactataaagtatctttgtgcaaattggaagaagacaccctttttggggcctagagtgggagacttgggtggtgaagactgaatttcagtccctgctcacccctgccctccccaagtcgccatctcacttctcccctatcacacacacacactgtaggccaagcgctcttgtgcagcaaccagtctgcacacccatgcacgggagtcccttttccccctacctccgtgcaggtcctgagctggaaagcccaggagcccagggctgatggggacctgttgcaggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtgagtgtggggccgtgtgggacaagggcactgaccttgagtggcaggagcctgctttcttgggtgatgctgatttcccgacttcctgtgtggcgctgcacaggtcacttcctttccttccctcccaggctttggcatcttcatcttcaaaatgagagggtgaggccgggacacctgctctgctctaaatttctagaatgtgctggaaatgtgattcaccttctcccagggacccagttctagtcccaaaaccagttcagattctttgtattacaataggcaaatcatatcttccatctgaacctcagtttcctcatctaaacaaagagggttacattacagcagtggtatccaaacccgcagtccatcagactgccatttggggatgccttttcaaaatagattctgattccaccctcaagattctcactcagtaggtcttggataaggtccaggaaactgtatttttaagttctctaagtgattctgattaacctgattgggatcggggcattcagtggtccctaagggcctgcttggaccttccttgcaggggagagaaacaagactcgttcatcaatgtctagcttcagaaccctgacctcctttccaagggagtacatttcaaatgaagaaaggctttgcttgataaaccaaggacaaaactcaagcattctttatactcagataaggggtattctcaagtaccaatagcatcacaatccaagattgataaccttgaagtgaggacatgggttcagatttggcttcatcatggggccaaattcctgaccctctctggatttcagtcctggtctggaaaacaggacaacacataactgcttcatttggctactgtgagaactgagtgagccctgctatgtgtaagagaaaccagcaatcatcctcataaacatcaaacttgggcccaaagccagcaagggagaaagagtctccacatggggagggaagaggccagacctcatggcctcaagtcctctcttctgagtcctttcttccccttggtggtggtagtggggatatttttcatgaattaccacttggaggacctggcttgatttattatacagggagccgatagttttcctaacacaagtggtcagaggtacagcagttctgcttggccgagctgttgaaggagactgttctcagagctcctccctctgtgatctttttgaggaagcgaggagaggtgtgaaagtgcttttaaactgtcaactggggttcctgtgggaggagttacccctcaatgacggtccataataagctcatgaaggggcatttggagcagccacgacactcagtgcacccttgtgtggggcagccctgccctgggccagaccctttgcaagaagtccacttggaggttgggcatggtgatgtgcgcctgtaatcccagctgctcaggaggctgaggcgggaggatcccttgaacccaggcgcttgagaccagcctggcaacttagtgggactctgtttcagg

SEQ ID NO: 1066 - DNA, 3715 bp, Homo sapiens
gagtttgagctgagccgaagcgaggaggctttcgactgagggctagcgaggggagcagggctgaagcagggctgaagcagggccgcggaccccgcacgctcctgcgggccccgtcctggagtccagtgtattccacaacgagcagcacttctgaaatccatgttgaatttcctcaagaaggccatccaagaccctgctttctcagatggcatacgacatgtgatggatggttctctgcctacctccctgaaacacatcatcagcaatgcagaatactatggcccatcactcttcctcctagctactgaagtggtgactgtgtttgtatttcaagaaccatcactgctctcctcactccaggacgatggattgacagatgtcatgctgcatgcactgcttatcaaagatgttcctgctacccgtgaagtccttggctccctcccaaatgtattcagtgcactctgtttgaatgcccgaggtcttcagtcttttgttcagtgtcagccttttgaacgcctcttcaaagttcttctgtctccagattacctcccagccatgcggaggaggagaagttctgatccccttggggatactgcatccaacctggggagtgctgtcgatgagctcatgagacatcagcccacccttaaaacagatgcaacgactgccatcatcaagttacttgaagaaatctgtaatcttggaagggaccccaaatacatctgtcagaagccatcgatccagaaggcagatggcactgccactgctcctcccccaaggtctaatcatgccgcagaagaagcctctagtgaggatgaggaggaagaggaagtacaggccatgcagagctttaattctacccagcaaaatgaaactgagcctaatcagcaggttgttggtacagaggaacgtattcctattcccctcatggattacatccttaatgtgatgaaatttgtggaatctattctgagcaacaatacaacagatgaccactgccaggaatttgtgaatcagaaaggactgttgcctttggttaccattttgggtcttcccaatctgcccattgactttcccacatctgctgcctgtcaggctgttgcaggtgtctgcaaatccatattgacactgtcacatgaacccaaagtccttcaagagggtctccttcagttggactccatcctctcctccctggagcccttacaccgccccattgaatcccctgggggctcagtgttgttgcgagaactggcttgcgcaggcaatgttgctgatgctaccctctcagcccaggccacacctctgctgcatgcactcactgctgcccatgcctacatcatgatgtttgttcatacttgcagagttggacagagtgaaattcgttccatctccgtaaaccagtggggctctcaattgggtctgagtgttttgagcaagctgagccagttatactgttccctggtgtgggaaagcactgtcctcctctctctgtgtaccccaaacagcctaccatctgggtgtgaatttggccaggcagatatgcagaaactggttccaaaggatgagaaggcaggtacgacccagggcggaaaaagatcagatggggaacaggatggagcagctggaagtatggatgcttctacccagggcttattagaaggcattgggctagatggtgacacattggctcccatggagacagatgaacctactgcttcagactctaagggcaaatctaaaatcacaccagcaatggctgccagaattaagcaaatcaagcctttgttatcagcttcctccagattaggccgagcacttgctgagctatttggacttcttgttaaactttgtgtgggatctcctgtccgccagagaaggagccatcatgctgccagcaccactacagcaccgacacctgccgcgcgatcaacagcctcagctctcactaagctcttgactaaggggttatcttggcagcccccaccatatacacctactccccgattcaggctgacattcttcatctgttcagttggtttcacatccccaatgctgtttgatgagaggaagtatccctaccacctcatgctgcaaaaatttctctgctccggaggccacaatgctctttttgaaactttcaactgggctctgtccatgggaggtaaagttcctgtttctgagggattggaacactcagacttgcctgatggcacaggagaattcctagatgcctggcttatgctggtggagaagatggtgaatcccaccacggtgcttgaatctccacattcgctgcctgccaaattgcctggaggtgtccagaactttccccagttcagtgcactgcgcttccttgtggtaactcagaaagcagcctttacttgcatcaaaaacttatggaaccggaaacccctgaaggtatatggtggacgaatggctgaatcgatgctggccattctatgccacatcctccgaggagaacctgtgattcgagagagactaagcaaggagaaggaggggtctcgaggagaagaggatacagggcaagaggaaggtggctcccgccgggaacctcaagtcaaccagcaacaactgcaacagctcatggacatgggcttcacaagggaacatgcaatggaggcactgttgaacaccagcaccatggagcaggccacagagtaccttttaacccaccctcctccaatcatgggaggagttgttcgggatctcagcatgtctgaagaggaccagatgatgagagcaattgctatgtctctgggacaggatattccaatggatcaaagggcagagtcacctgaggaagttgcttgccggaaggaggaagaggaacggaaagctcgggaaaagcaggaggaggaagaggctaaatgtctagagaagttccaggatgctgacccgttggaacaagatgagctccacactttcacagatactatgttgccaggctgcttccaccttcttgatgagctgccagacacagtataccgtgtgtgtgacctgatcatgacagcaatcaaacgtaatggagcagattatcgtgacatgattctgaagcaagtagtcaatcaggtgtgggaagctgctgatgtattgatcaaagctgctcttcccctgacaacaagtgacacaaaaaccgtgtcagagtggataagtcagatggccacactgccccaggcctccaatttggctactagaatcttgcttttaacgctactttttgaggagttgaagctaccttgtgcttgggtggttgaatcaagtggcatccttaatgtcctaatcaaactcttggaagtggttcagccctgcctccaggcagccaaggagcagaaggaagtccagaccccaaagtggatcacaccagtgttgctcctgattgatttctatgaaaagacagccatctcctcaaaaaggagagcccagatgactaagtacctgcaatccaacagcaacaactggcgctggtttgatgatcgctctgggcgttggtgtagttacagtgcaagcaacaatagcactattgattctgcctggaaatctggagagacaagcgtgcgattcactgcaggccgaagaagatacacggtccaattcactacaatggtgcagggtacctcggctgaataaaaattcaaaaaacagcaatggacaggaactagagaagacgctggaagaaagcaaagaaatggatatc

SEQ ID NO: 1067 - DNA, 2338 bp, Homo sapiens
gctttggcgctcccaaggactccccgccactctccccacaaagcagcggcggtggcggcggctgctgctggatcttcacactgcagccagcagcccaggacgcccctggccggacgatgggtacccgcgcctgagcatcccccgggcaggcgccaggcgcgaaggcagggggcgggaggaaaggggcgggggaattcctgattccctggtggaccctggaagttgtccttaaataaatatatcgctggcccgcggttgagcagccacctcgtcagagcagcatgtggactggctcgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagttgagactctgcgcctccgcccggacccacatggcttgttacctggtcatcagttcgagacatctcagcaatgggcactaccggggcattaaaggagtcttcaggggacccctgtgcaagaacggatctccctctccggattttgcagaaaagaagtccacagcaaaggccctggaagatgtaaaggcaaacttttactgtgaattatgtgacaagcagtatcacaaacaccaggagtttgacaatcatattaattcttatgaccatgctcataagcagagactgaaagaattaaagcaacgggaatttgctcgaaatgtagcttctaagtcatggaaagatgagaaaaaacaagaaaaagcacttaaacgacttcatcagctggctgagttaaggcagcaatctgaatgtgtttctggaaatggaccagcatacaaagcccccagggtagccatagaagagcaactccagcaaggaattttccccattaagaatggcagaaaggtatcatgcatgaagagtgctcttctccttaaaggaaaaaatctccccagaatcatatccgataaacagcggtccaccatgccaaatcgacaccaattacaatcagacaggcgttgtttgtttggaaatcaggtactgcaaacatcttcagatctcagcaatgcaaatcacagaacaggagtatcatttactttttccaaaaaagtgcacctaaaattagaatcttcagcatcagttttcagtgagaacacagaagaaacccatgattgtaacaagtcacccatttataaaacaaaacaaactgcagataagtgcaagtgctgcaggtttgcaaataaagatacacaccttaccaaggaaaaagaggtaaatatctcaccaagccatctggaaagtgttttacacaataccatctccataaactctaaaattttgcaagacaaacacgactctattgatgagacactagaagattcaattggcattcatgcttcattctctaaatctaacattcatctttcagatgtagattttactcctaccagcagagaaaaagaaactagaaatacattgaagaacactttagaaaattgtgttaatcacccatgccaagcaaatgcttccttcagcccaccaaacatttacaaccatagcgatgccaggatatctgaatgcctggatgagttttcatcactggagccaagtgaacaaaagagtacagtgcatctgaatccaaattccagaatagagaacagagaaaaatctttagataaaacagaaagagttagcaaaaatgttcaaagacttgtaaaagaagcatgtacccataatgtggcatctaaaccactaccttttctccacgttcaaagcaaggatggccacaccactcttcaatggcctacggaacttctgctctttacaaaaacagaaccctgtatctcttatggctgcaacccactgtattttgattttaagctttctcggaacacaaaggaagaccacaatctagaggacttaaaaacagaattgggtaagaagcccttggaattgaagactaaaagagagagccaagtctcaggtttaactgaagaccaacaaaaattgatccaagaagattatcaatatccgaaaccaaagacgatgatagctaatccggattgggaaaaattccagaggaaatataatttggactacagtgattctgagccaaataagagtgaatatacttttagtgcaaatgatttggaaatgaaaaatcctaaagtgcctctttacctcaacacatctctaaaggattgtgctggaaagaataatagtagtgagaac

SEQ ID NO: 1068 - DNA, 2727 bp, Homo sapiens
gcactccggccgggctctgctggctgcggcgggagctggacgcgggaggaggcggcggcggcgctggaacagtgaaccatggagctgtatttcggtgaatatcaacatgtgcagcaggaatatggggtccatctgagactcgcaagtgatgatacccaaaaatcaaggagttcccagaactccaaggcaggctcctacggtgtcagtattcgggtccagggaattgatggtcacccctatattgtcctgaataacacagaacggtgcctagcaggcacatcgttttctgaaaatgggccaccctttccacctccagtgataaataacctgcctctacattccagcaatggttctgtgccaaaggagaacagtgaagaacttcagcttccagaaaacccatacgcccagcctagcccaataagaaacctgaaacagcccctgctccatgagggcaagaatggagttctagatcgcaaagacgggtctgtgaagccatctcacctgctgaactttcagaggcatccagagcttttgcaaccctatgaccctgaaaagaatgagttgaatttacaaaatcaccagccttctgagagtaattggctaaaaacgttgacagaagaaggcatcaacaataagaagccttggacttgctttcccaaacctagcaattcccagcctaccagtccctccttggaagacccggccaaatctggtgtgacagctattcgtttatgcagctccgtggtcatagaggaccccaaaaagcagacctcagtgtgtgtaaacgttcagagctgcaccaaggagagggtgggagaggaggcccttttcactagcgggaggcccctgactgcccacagcccacatgcccaccctgaaaccaagaaaaccaggccagatgttcttcccttccggcgacaggattcagcgggacccgtcctggatggagctcggtcccggaggtcctcctcgtcatccacaactcccacgtcagccaactctttgtacaggtttttactggatgatcaggaatgtgccatccatgccgacaacgtcaatcgtcatgaaaacagaaggtatattcccttcctgccaggaactggacgggatattgatacaggatcaattcctggtgtggatcagttaattgaaaaatttgatcaaaaacctgggcttcagagaagaggaaggtctgggaagcgaaacagaattaatccagatgacaggaaaagatccagaagcgtggatagcgcctttccttttggcctccaagggaactcggagtacctgattgaattcagtaggaacttgggcaagtcaagcgaacacctcctccggccttcccaggtgtgcccgcagcggccactgtctcaggagcgccgtgggaaacagagcgtgggccgcacctttgcaaagctgcagggagcagcgcacggggcttcatgtgcccactccaggcctccccagccgaacatagatgggaaagttctggaaaccgaaggtagtcaggaaagtacagtgatccgtgcgccctcccttggtgcacagagtaaaaaggaggaggaggtgaaaacagccaccgctacgctgatgttacagaaccgggcagcagcaacttcgcctgattctggtgccaagaaaatttccgtgaagacatttccttcggcctcaaatactcaggccacaccggatctcttaaagggccagcaagagctcactcagcaaaccaatgaggagacagctaagcagattctctacaattacctcaaagaaggaagcactgataatgacgatgctactaaaaggaaagtcaacttggtctttgagaaaatccagaccttaaagtctcgagcagctgggagcgcccaaggaaataaccaagcttgtaattccacatctgaagtcaaagatctattggaacagaaaagcaagttgaccatagaagtggctgaacttcagagacagcttcaactggaagtcaagaatcaacagaacattaaagaagagagagagaggatgagagcaaacctagaagagctccgaagccaacacaacgaaaaggtggaggagaactccacattgcagcaacgactggaagaaagtgaaggggagctccggaagaatctggaggagctattccaggtgaagatggaacgggagcagcatcagactgagatcagggatctccaggaccagctctcagaaatgcacgatgaactggacagtgcaaagcgatcggaggacagggagaagggagctctgattgaggagctcttacaggcaaaacaggatcttcaagatctgctgattgccaaagaggagcaagaagacctcttgagaaagcgagagcgtgaactcaccgccctgaagggagccctgaaagaagaggtttccagccatgatcaggagatggacaagctgaaggagcaatatgatgctgagttgcaggccctgagggagagtgtggaagaagcaaccaagaatgtcgaggtcttggcgagcaggagcaacacttcagagcaagaccaggcggggactgaaatgcgcgtgaagcttctgcaggaggagaatgagaatctgcagggaagaagcgaagagctggagcggagagttgctcagcttcaaaggcagatcgaggacctgaaaggcgatgaagccaaggcgaaggaaacgctgaagaagttcgagggagaaatacgacagttagaggaggcccttgtgcacgcc

SEQ ID NO: 1069 - DNA, 4097 bp, Homo sapiens
gtggcccagaggcgcgagggccggcggagtttcttcagaggaactaccgccctgggaggaagcgtctgtttagtttcaacacagacgactgggcttgggagcctacgaggttgcagtctggagggcgccaacagcagctaccagggctgcttttcctgaacacgctgcaagcacgtcaaggtagtcggagtcccctaacaatggataaattcgtcattcgaacgcctagaatccagaatagccctcagaagaaagattctggaggaaaggtttacaagcaggccacgattgaatctctgaagagagttgtggttgtagaagacataaaaagatggaaaactatgctggagcttcctgatcaaaccaaagagaatcttgttgaagccttacaagaattaaagaagaaaataccctccagggaagtgttaaaatcaacaaggataggtcacactgtgaacaagatgcgtaaacactcagattcagaagtggcttctcttgccagagaagtttacactgagtggaaaactttcactgaaaaacattcaaatagaccttctattgaagttagaagtgatcccaaaaccgagtcgttgaggaaaaatgctcagaaattactctcagaagccttggaattaaagatggatcacctactggttgaaaatattgaacgggaaacgtttcatctctgctcccgcctcattaatgggccgtaccggcggacggtgagagccctggtcttcacattaaagcaccgagctgaaatccgggctcaggtgaagagcggctcgctgccagtcggcacgtttgtacagacccacaaaaagtgacctgaggacggttccagccctgggccaggcagagaggaaaatgggcctgtctctgccgttcaaagacgcttttgagtttgggtgatggctgatgctggctgtgctagattttcccatggtgccgttcctttgcagacagaggattcggagagccctaggagacaggcctgcaggaatgtgcttcattagctgcagtgcgctggtgctgcctaacagaacgcacactggctgtcactaggaagcgccatacggttgctatcacccaacatggtgaaagggtgatggatttcactgtgaatatgccaaggacacctctaaacttcccccatgtcagtcagatgaagttactactatatttcaccaccctgcaggtaactgaaactcaattaccgctgccgctcactcggttccatccccctgagtttagatagctctggtgcctctcagaactcccctgtctgttctctttgctctatcccaggggtgagcctgcgagagccagccaactaccccttcttcccagagctcacttatctgaacgtttcagctctccctggaagaccttctgcgttggtctccagagcccccatgctggggctactaatgaggaactggcccgaagcctcccacacctcagggtttatttgaatacgctggcgctctcagtttagggctctgtagaagatacataatgaaatttctcttgaaatgaattactgcagtagaaaaaagtacatacatatatatgttaaaatgaaatatctctacacaggcctgttttaacaattacgtaaataatacttgtttttttaaaagtaatagtaagctgggaacttttttttctaaaacaaaaggtggagttcgttcactgaaaagtgttttgagttgagaaagggtacagttggtgaaatttaaaaatgatggaacaaggatttgaggaatgtagaagactcaaggaagtggggattagattaggggagactggagcacgtttgtaatctgaaaggaaagagctggtagaaggggagagatttaaaatccaaaaaaaaggaagatgagttgaaaagcaaggggagaagggacgggactaacattattgcctaccttctaaatactaggcacttttcctaagacagtttattaacctttacctggatctttatatagttttgtaaaaatattgcttacttctctcacccgttgtattaagtaggtattgttgttttcattttttagatttattcgtttatttagcaaccatttcctgagcatccattctgtggggtaggtgtatactgagcagtagttacaaatgggagcctgaggctcactgaacagaaacatcaccttcaatttcctactgctagtaactattggagctagaataataataatcgagcgtttaccctgggcccagcactgtggtaaccattttacaaaaagaaaatacccagttaaacatgagaaaagtgaggctcagaaaggtatagtaacttactcaaggtcacgcagatagtgaatgacagatctaagattcaaaatccgggtctatttgattgtatatggttgccttggatgatttcatctactctcatgttttcaagcatcatttacatgctgatgacattccagtttgtatcgtcagcccagacctgtcccctgactttcagatgatatttcctagatgccccatagacatctcagatataacatgtcttctttccattggcagtaccagcaagccagacactccagctaggaactcaaggagtcagcctagaccccacatctcccaccctcagccaaccaagtcctggtggtttgattaggttggtgcaaaagtaattgtggtttttgccattacttctaatatattacttctttgcatttgctgttccagttgcaatgctctttccccagacatctgcatgttcttgtcctcacttgctttaggtctctctttcccttatcaaaaaggcttttgctgactatcctaaatacaatagcactccctcccaactattctttaatgctgtgcctagctttatttttcttcagaatatttattactctttaacatagttatttctttattgtctatctccccactcccagaatgtaagcttcatgaaagcagagtctctgttctgttccctgttatatctccagcatctggaacagagcctgggacaagctaggtctccataactatttattggatagttgagtgactggttgtggatgtacagtataagcatctaattcaatcagggagtgcttcctggaggagctgatacctgtgttcagtcttaaagggcaggagtttggataggggaatgttagttaatagaatgaaaatttcaaaattaaagggcaggagtaattaattgggtggttgagatgcatgcctggcagagcaagcagagtatggaaaaacccagaagtggagatatctggaaggtgattggtatggctggagtagaggacactggcaggagagtagctggagatgaggcaggagaggaaggcaaggaccaggatcaggtttgaagggtcttgagcatcaggtgaaggcgttagactgatttgaagcaggaactggtcacttttgtgttaataggctatgtggaagagaagctggggtagggagacaggaagtagcaagcttcatgtttaaagaaccaaagagttctgctaacttaggaacccagagtaagttgaaaacaaattgctctctggctgaaagccttcagtggtgatagttggaaagtagaatgattgcagagatgtgctttggagatttggaaagcaggctgtgttatttgtggctgttttctccttgatgcatgtgcagaatttccatgaacgctaatggagctattctgagcatttgctgaagggaaggaagcttgcagacatccctcccaatcttgcccacacactgagaagtaactcggagctacagtctgttaaaaatgaaaaggttgaggccgggtgcattggttcatgcctataatcccagcgctttgggaggtcgaggcaggcagatcacctgaggtcaggagtttgaaaccagcctggccaacatggcgaaaccctgtctgtactaaaaatacaaaaattagccagatatgatggcaggcgcctgtaatcccagctacttggaaggctgaggtatgagaatcgcttgaacctgggagatggaggctgcagtaagccaagattgtaccactgcactccagcctgggcaacagagtgagactctgtctc

SEQ ID NO: 1070 - DNA, 2607 bp, Homo sapiens
cattgtgccacacaggcaatgagcagttggacctaagaaagaagcaggagcgcccatcataccactctggtcaaagtgggtgtggctctgattttatcttggagacccaggcagttaactccctggaggggaagggaagagttccttgggaggaatgctttccatatttcccttctggcctaaagagaaagaagctggaacctgtgtatcaggcaaggtttggagcctagtggttggccctttatgccttccatactgtttattataggacaggagctagtgtgtgagatggctctggtgtgggaagagcctttccccagggttgggaggcctaggttgggtgacctaggttggatattcacccctccctgtgggtcatccctgaaggctcagccctccttaggtagccagtaccttgcactcctgggagatggtatggttagctgggaaagtgacctccttctgagtctctcttagcagctttttgagattggtgtcatcaaagggcagatgggcgaccactagagtgtaaaggatgacgcccatgctccaggtgtcagacaggaaagggttgtagggcaagcctcgtaagatctctgggcaagcgtaagcaaagctgccacagtaagtctggctgaggtgggaaaagcagttcacttggcggtaagaagggctacaacccacaggctggttagaaggcaccatcttggcaaagccaaagtctgatatcttcacattctcccacttgtccagcaacaggttctccaactttaagtccctaccagcagcagaaaggctgggcatcaggctggggagagggcttagttttagactgggagctgaagggccaggggtcagagggtaaagatgaggacagaggaagtgggaggtagaaaccattatgagggcacaaggtagagaggaaggaaagccatggagttgtgagcagagcccaaagtagggagagagacagaggatggtatctgaggaccaccgggagctcaccattgtatttcataaaatgctttgcatacagtgagtactttatcagtatccttgaccatatgattaaaatagagtgcatgaataggctagatattgaggagggagttcgaaagaggaaaaaaggacaggaaatgggagatgtgcataaaacccccttgagggcaaaggccccagtcagggtggcagcgccctcaccggtgcacgatgctcttgctgtgcaggtaggcaatgcccagggtcagctgggagaaccacttgccagcaaggggctcagagcaggccccgtagcgctggatccattcaaggacatcaccaccctgagccagttccagaatgatgtatactcgagatgtgctctcaatggcccgatagaagttgatgaggtacttgtgccgcaagactttcattacctgaccccagaagaaggacccatcaaacctgggaagggagaaccctgactgcactcccagccgtctcctaccctcagctactgacttaggactttgcaataggatcagcccctcaaccccagagaactggtggcctgtgggcaaatgctatgttttgtgcctttactttttggggactgaaggtgagtgggtggatgggaaagaggtttaacttacataaagtttcctagctgcttagtgagacatttcagttctggtttaggggtttctggccccacccctcctggccataccccttctgagaaacctcaagcagcttagtaccaagctccagttccctcttccagccccctttccaacctgtatttcacggggcaggaacttgttaagatagtcatcagaggccttcttctttgagatgatcttgactgccaccataaccttctgctttgtgtagaaagcctcatataccgacccataggagccatggccaatggccttgcccacctcataaccatattcatccatgagggaatggtaggctgtggtggttggtgctgcctctaagacatctcccttccccatggtgttgggcttgctgagagcagggagctttactacttggaagcctcctatccaaaggccaacaccttgagctgctgaaggctagggtatcaaagtgaagtaggtccccaaatgcttgcctatatagtcacacgagtctgggatgctggactcagccctccactaggaacttggagggggaaagaaagagaagcagttctttttgtctccactggctgttgttactttctccttttggttacggaactcctcaaggtcccatgttccgaatacatcacaatccacctcctatccatcgttggccacaaaacttgagaatgaagtgcggccgggcgcggtggctcacgcctgtaatcccagcactttgggaggccgaggcgggcggatcgcgaggtcgggagatcgagaccatcccggctaaaacggtgaaaccccgtctctactaaaaatacaaaaaattagccgggcgtggtggcgggcgcctgtagtcccagctacttgggaggctgaggcgggagaatggcgtgaacctgggaggcggagcttgcagtgagccgagatcccgccactgcactccagactgggcgacagagcgagactccgtctc

SEQ ID NO: 1071 - DNA, 1562 bp, Homo sapiens
aacacaaagtccagggttggagcaggagcaggggagggacaatggaagctgccccgtccaggttcatgttcctcttatttctcctcacgtgtgagctggctgcagaagttgctgcagaagttgagaaatcctcagatggtcctggtgctgcccaggaacccacgtggctcacagatgtcccagctgccatggaattcattgctgccactgaggtggctgtcataggcttcttccaggatttagaaataccagcggtgcccatactccatagcatggtgcaaaaattcccaggcgtgtcatttgggatcagcactgattctgaggttctgacacactacaacatcactgggaacaccatctgcctctttcgcctggtagacaatgaacaactgaatttagaggacgaagacattgaaagcattgatgccaccaaattgagccgtttcattgagatcaacagcctccacatggtgacagagtacaaccctgtgactgtgattgggttattcaacagcgtaattcagattcatctcctcctgataatgaacaaggcctccccagagtatgaagagaacatgcacagataccagaaggcagccaagctcttccaggggaagattctctttattctggtggacagtggtatgaaagaaaatgggaaggtgatatcatttttcaaactaaaggagtctcaactgccagctttggcaatttaccagactctagatgacgagtgggatacactgcccacagcagaagtttccgtagagcatgtgcaaaacttttgtgatggattcctaagtggaaaattgttgaaagaaaatcgtgaatcagaaggaaagactccaaaggtggaactctgacttctccttggaactacatatggccaagtatctactttatgcaaagtaaaaaggcacaactcaaatctcagagacactaaacaacaggatcactaggcctgccaaccacacacacacgcacgtgcacacacgcacgcacgcgtgcacacacacacgcgcacacacacacgcacacacacagagcttcatttcctgtcttaaaatctcgttttctcttcttccttcttttaaatttcatatcctcactccctatccaatttccttcttatcgtgcattcatactctgtaagcccatctgtaacacacctagatcaaggctttaagagactcactgtgatgcctctatgaaagagaggcattcctagagaaagattgttccaatttgtcatttaatatcaagtttgtatactgcacatgacttacacacaacatagttcctgctcttttaaggttacctaagggttgaaactctaccttctttcataagcacatgtccgtctctgattcaggatcaaaaaccaaaggatggttttaaacacctttgtgaaattgtctttttgccagaagttaaaggctgtctccaagtccctgaactcagcagaaatagaccatgtgaaaactccatgcttggttagcatctccaactccctatgtaaatcaacaacctgcataataaataaaaggcaatcatgttatagg

SEQ ID NO: 1072 - DNA, 1749 bp, Homo sapiens
acgtagagaagatacagtaaaagtatggtatagggaaattttttaaaaggtatatctgaatagggcacttaccataatggagcttacaacactggaagttgctctgagtgagtcaataaaactttttgactttataataacacttaaaacagttgtacagctgtacaaaaattctttttttaaacttttttactttttagacttttttgttaaaagcaaagaagaaacacacattagcctaggcctgcacagggtcaggatcatcaatatcactggcttctatctccacatcttctcccactggaaggtcatccagggcagtaacatgcatggagttgtcatctcctgtaatgatgataccttctggaatacctcctaaaggacctgtctgaggctgttttatagttaaccttgtcttaataagtaggagtagtatactctaaaataatgataaaaagtaggcccggcatggtggctcacacttgtaatcccagcactttgggaggccaaggcgggcagatcacttgaggtaaggagtgtgagacagcctaaccaacatggtgaaaccctgtctctactaaaaatacaaaaattaggcatggtggcaggcacctgtggtcctagctactcaggaggctgaggcaggagaattgcttgaacccgggaggcagaggttgcagtgagctgagatcacgccactgccctccagcctgggcaacagagcaagactccgtctcaaaaaaaagaaaaaaagtatagtaaatacataaaccatagcatagtcatttattattatcaagcgttacgtactgtacataattgtatgtgctatactttttatgactggcagcacaatttgtttacaccagcattaccacaaacacgtgagtagtgtgttgtgctatgtgatgctgggacggttaaaaggtcactaggcaataggaatttttcagttccattataatcttacgggaccaccatcatatgtagggtccactgttgactgaagcattgttatgcagcacatgactgtatcatatacatgcaaagaaaacaaagaccagtaaagccttttttttgtagttccagctactgaggtggctgaagcaggattgcttgagcccaggagtttgaggccagcttgggcaacatagcaagacagtgcctaaaaaaccgaaacaaagaaccagggaaatattaacagtggttgtctgtgtgtagtaggattaaggattcatttcgtgttcacatgctatatgtttatgtatttcccaaatgttttgttatgtttaaatattgcttttatacgtagaaacaattacattattttaaatattgtatcctaaagcaaacaacatctttaatcttgcagtgaagtcccactgattacgttttactgaatattttcttcctgcatttcaggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagttaggccattcatttaatgtgcattaggcacttttctgtttatttaagagtcaattgctttctaatgctctatggaccgactatcaagatattagtaagaaaggatcatgttttgaagcagcaggtccaggtcactttgtatatagaattttgctgtattcaataaatctgtttggagg

SEQ ID NO: 1073 - DNA, 2912 bp, Homo sapiens
ctttaatacaattatgacactcccttttgaacttgtgatatatacctgccgctaacacacacacacacacacacacacacacacacacacacacacacaccttgagaggctgttgccaattgttctttaggcatcacacacagccccggcacacagcaggggcttaatagatattccttacatcgaagttgaaagtcttgtctcaacattctgctctcacacactcgcctacaaactcatcaaataatagagcatcgattctcattctctccctctcccttccttttaaatctcctggggcttagaatccataatttgtggaattcccgcattcccacaggtgtcctgggaggtgggcagggccaacacttcagcagcttctgcaacgcagcagactcctgggcctgatgtgctagctgcccatttgctatgggccttcgctccccagaagcacctctctgggtatggggcaaacacccctcattgctgcaatgcagcctctgctggagtgaaacaggatgcttgatttctattgcgtcagtagcaacactgcccagaggtctaagagaggaagtcagagcaaagcccatcaaagcccacccagaacagcagggaaattccaagtcatcggtttctagttctccccatgcgtgtggtggccctgctttgtggtgagcctccaggactgtcctgctgtgcctctgaagcacctgctcacagaagggtgacccattgaggcatgcagtgggttgatacaaatgtcaactccagcccctgtcatcagctaaaggtcagcaaatgagttctctggcatttggggtctgcaggggcaagtgagtactgtgaacacctgcagtgtggagaccacgtccatctaattggcgtctatggggcccagtgccaggctgggcccaagtgtcgattcaggaagggtgtctcaggatgcagaagccgcctgatgcgtgcagaggtggataggccttcagcctgctctcctcctctgtcctgcagaccgggtgagttatgttagcctctgctttcccttcctgtcctgagcacagcaatcgggacaaccacacatcctctgagagatgataaaaataatgagaccaagaagactgcacccaaatcgatgttttgtctttgcgcagaccccatagtgtgtcttgtgctgcagagggaagcacctggcatcttggggcctcttctctgccccctccccactttggggaggggttttgtcgggggcagcctccatcctttggaatcctgtctgtgctctgattctccctgatggtctttatagctttgcattattttgctttcagagaacagagaaatgtgaataagaacagaaacatggcaccggtgtcctcagcttcttccccaccttcacagaactgctgctgcaaactagtagttttgagaaatgatgaaaaacctgtggttttccccaaattccaagaatcagaggcagattctaggagggtgaagatggtgtgggctcaaaaatggtcatgcggcacatcttctgaggagatatgctgcccattaaaagggcaaaacaggagttggtgtgtgggcagttcccgcatcacacataaaggcttcaccagtgaggctcagcccaggaactgcctgcccttgaggctgggggctcacaaagaaagctttcccccagcttctgatgtccatgaagagcagagagcatgctggtggtgattcataaccccctgaaatgtatcctcagtttgccagagaaaaatttctaggacccacctaataagttcattcattggttcccagactcggcaggttttaccagatccctcacgactggtcccagcttctctcccagcacattacttgaaggtacacaaatagtccactgtgctttgtttcctctgtttcttccaattctctcttctgcttgaccagcttgtacttgaagatctaggttttgggagattcccgggattgctgccaggcactgcctgcccccatctgagtaaggggtgtaaaccccaagagtatctgagacaagtgtcagttaatctaggattgtatattgccaaggttaagaacatgcccaggacacagccttgggaggtcctgaccacatgtgcccaaggtagtgggcctacaacttggttttatacattttagggagacataagccatcaatcaatacatgtaacatgtacattgttttggtctggaaagttgggacaaccggaagggggagcttccaggtcacagtcagattcaaagacttcctgactggcagttgattgagttattatctaaagacctggaatcaagagaaaggaatgtctgggtgatggtaaggggttgtagagattaaggttttgtcatgccgatgaagcctccaggtaacaggcttcagagagaataggtcataaatgtttctactcagacttaaaaaggctgttctatcagtcattcctaaaggaaggagggtatcaagaggctgttctatcagtaattcctaaaggaaggagggtatcaagacgcacgtctggctcccccttcccctcatgacctgaactagttttataggttaactttggaatgccttggctgaggggccatgcattcagatggttgggggccttagaattttctttttggtttacagggacttgcactcacagtggcctggctgtctgtctgtctgtctaacctggcattatgcacacactttgagttatcttattcctgctctgtgttctcattgcatgagatccttgggtgcaggaactacgtctcctccttgttctccagagtacaaatttttctttcaataactgtgcactgagctccaattttgttccaatggctgtgctaagctctgtagatgaagtcgaaaaaaataaagaagtaaagacatc

SEQ ID NO: 1074 - DNA, 1988 bp, Homo sapiens
aaggagagaaaatggcgtccacggattacagtacctatagccaagctgcagcgcagcagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcagtctgcatatggcactcagcctgcttatccagcctatgggcagcagccagcagccactgcacctacaagctattcctctacacagccgactagttatgatcagagcagttactctcagcagaacacctatgggcaaccgagcagctatggacagcagggtagctatggtcaacaaagcagctatgggcagcagcctcccactagttacccaccccaaactggatcctacagccaagctccaagtcaatatagccaacagagcagcagctacgggcagcagagttcattccgacaggaccaccccagtagcatgggtgtttatgggcaggagtctggaggattttccggaccaggagagaaccggagcatgagtggccctgataaccggggcaggggaagagggggatttgatcgtggaggcatgagcagaggtgggcggggaggaggacgcggtggaatgggcagcgctggagagcgaggtggcttcaataagcctggtggacccatggatgaaggaccagatcttgatctaggcccacctgtagatccagatgaagactctgacaacagtgcaatttatgtacaaggattaaatgacagtgtgactctagatgatctggcagacttctttaagcagtgtggggttgttaagatgaacaagagaactgggcaacccatgatccacatctacctggacaaggaaacaggaaagcccaaaggcgatgccacagtgtcctatgaagacccacccactgccaaggctgccgtggaatggtttgatgggaaagattttcaagggagcaaacttaaagtctcccttgctcggaagaagcctccaatgaacagtatgcggggtggtctgccaccccgtgagggcagaggcatgccaccaccactccgtggaggtccaggaggcccaggaggtcctgggggacccatgggtcgcatgggaggccgtggaggagatagaggaggcttccctccaagaggaccccggggttcccgagggaacccctctggaggaggaaacgtccagcaccgagctggagactggcagtgtcccaatccgggttgtggaaaccagaacttcgcctggagaacagagtgcaaccagtgtaaggccccaaagcctgaaggcttcctcccgccaccctttccgcccccgggtggtgatcgtggcagaggtggccctggtggcatgcggggaggaagaggtggcctcatggatcgtggtggtcccggtggaatgttcagaggtggccgtggtggagacagaggtggcttccgtggtggccggggcatggaccgaggtggctttggtggaggaagacgaggtggccctggggggccccctggacctttgatggaacagatgggaggaagaagaggaggacgtggaggacctggaaaaatggataaaggcgagcaccgtcaggagcgcagagatcggccctactagatgcagagaccccgcagagctgcattgactaccagatttattttttaaaccagaaaatgttttaaatttataattccatatttataatgttggccacaacattatgattattccttgtctgtactttagtatttttcaccatttgtgaagaaacattaaaacaagttaaatggt

SEQ ID NO: 1075 - DNA, 2652 bp, Homo sapiens
ctaggtgatgcgaatatacagtgatgaataaaggagatatggtctttagacttttgagagtttaagtcatagtggaaggagatagacagtaaacaagtaagctaataaaagagcacctgatagtgatgagtgctgtgaagaaaataaaatattagtgtgaaaataacaggggccgggcgtggtggctcaggcctgtaatcccagcactttgggaggcccaggcgggcgaatcacctgaggtcaggagttcaagacaagcctgaccaacatggagaaaccccatctctactaaaaatacaaaattagccggggtggtggcacatgcctgtaatcccagctactcaggaggccgaggcaggagaatcacttgaacccgggaggtggaggttgcggtgagccaagatcgtgcttttgcactccagcctggacaacaagagcaaaactccgtttcaaaaaaaaagaaaataactgggagggatactcaggaaatgtattggttttcttaaaacctgtcttgtgatcctaaactctctttagcctttcttattctcaaaaacaccatctgtggcgtggtcctctgcggagaatggtagcagcgtgaggtggaggcaccacaatcccttgtcacctgggccaaaagcagctcatagcccatttctattcagatctgtgtacaggtgttcataagaccaagatgaataagacactgtgttcctgtcaaagggttcatgttcccttctgtgttagtccattcttgcactaatacttgagactggataatttctaaagaaaagaggtttaattgacccatgcttctgcaggctatacaggaagcatagtggcttctgcttctggggagacctcaggaagcttccagttatggtgtaaggcaaagggggagggaggcatctcacatggcgggattaggagcaagagggagtgaggggggagatgctacacacttttaaacaaccagatcttgggaaaactcactatcacgagaacagcaccaaagggatggtgctgaaccatttatgagaaaaccagcctcatgatcccaccaccagcccccacctccaatatggggactacagtttgacaggagatttggcggggacagatccaaaccatgtcaccttcaaaggactcacctccagcaggagggagagaaaggtcaattagccatcgtagtattactgtatagtgatgattgcagagctaggcatagatgtggcgcaagtaactgtcacctgtctttggaggagagatcagaggaggaaatggaacccaaagatctgtctaccccctcagagatgttggtaattctgcatgaaaaaccagtttagtgctcgcctcagcagcacatatactaaaattggaacgatacagagaagattagcatggcccctgcgcaaggatgacatgcagattcgtgaagcgttccatatttttgtctccctggacttcgagcaggagatggccactaccacatcctcctccctggagaagagctacaagctgccggatggccaggtcatcaccatcagcaacaagcggttccagtgtccggaggcgctgttccagccctccttcctgggtatggaatcttgcggcatccacgagaccacgttcaactccatcatgaagtgtgacgtagacatccgcaaagacctgtacaccaacatagggctatccagaggcaccaccatgtacccgggcatcaccgacaggatgcagaaggagattaacgccctggcatccagcaccatgaagatcaagctcattgtgcccccagagtgcaagtactctgtgtggatcagcggctccatcctggcctcactgtccaccttccagcagatgtggattagcaagcaggagtatgacgagtcaggcccctgtatcgtccaccgcaaatgcttctaaatggactgcgagccgatgcgtagcatttgctgcatgggttaattcagaagtataaattggccctggcagatacatatacctcatgctagcctcacgaaaatggaataagccttcgaaaagaaattgtcgttgaagcttgtatctaatatcagcactgggttgtagaacttgttgctgattttgaccttgtattcaagttaactgttccccttggtatttgtttaataccctgtacatatctttgctttcaacccttagtacatgtggcttggtcactgcgtggcaaggtaagaatgtgcttgtggaagacaagtgcgacttggtgagtctgcatggccagcagtctccgatctttgcagggtattaatatgtcatggctgagtgttctgggatttctctagaggctgacaagggctcctgaaccagttgtttctgtcctgctggtctgtcagggttggaaaggccaagccataggacccagtttcctttcttagctgatgttttcctgccagaacactgtgggctgtgacttgctttgagttggaagcagtttgcatttacacctgtaaatgtattcatccttttaatttatgtaaggtttttttttgtatgcaattctcgattctttaaggagatgagaacagattttggttttctactgttatgtgagaacattaggccccagcggcatgtcattgtgtaaggaaaaataaaagtgctgctgtaacc

SEQ ID NO: 1076 - DNA, 3152 bp, Homo sapiens
aagaatcttttgataaaacatgcatttgacacaagataccagcacaagaaccaacaagccaaaatagcacaattgtacctcccctttgttggactacttttggaaaatatacagcgattagcaggtcgagataccttgtattcttgtgcagccatgcctaattctgcatccagagatgagtttccatgtggctttacttcacctgccaatagagggagtctgagcactgacaaagacaccgcttatgggtcttttcaaaatggacatggaattaagagagaagattcaagaggttccctcatcccagaaggagcaacaggatttccagatcagggcaacactggtgaaaatacccgacagagttctacaaggagtagtgtatcccagtataaccgcctggatcagtatgaaatcagaagcctcctgatgtgctacctgtatatagtaaaaatgatttcagaagatactctcttaacttactggaataaagtatcacctcaggagctcataaacattcttatacttttagaagtatgcttgtttcactttagatatatggggaaaagaaacatagcaagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagttctacaacaactgaagcagacattttccaccaggcacttcttgaaggcaatacagctactgaagtttccctaacagtactagacaccatatcatttttcactcagtgcttcaagacccaacttttaaataatgatggccataacccattaatgaaaaaagtgtttgatatacatcttgcttttcttaaaaatggacaatctgaagtgtcgctgaaacatgtatttgcctcactgagagctttcatcagtaagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacagataataattgctgtaagccaactgatagctgatgtagcactaagcggaggatcaagatttcaggagtctttattcattatcaataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttggaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaattagaagtgaaag

SEQ ID NO: 1077 - DNA, 2404 bp, Homo sapiens
agaaaaggaatgaatttgaaggaggaagactggatgccaatgatcctgatctcactctgtcaccaaggctggagtgcagcagcagaatttcagctcactgcaacctcgacttgctgggttcaagggatctcccaagtagctgggactacaggtgcacaccatcatgcctggctaattttttgtagggatggggttttaccatgctgcccaggctggtcttgaacttctgagttcaagcgatcctccctcctgagcctcctaaagtgctgggattacaggtttaaaaaatatcctggactttggaaaatattcttatataaagaagcaaaaagaggatggaatagacttgtgctaacactgaaactccagtcaagttgtaaactgaaaaagaacgtgttgaaacaaggaattgccccatagccttcacaggatctcactctgttgcagtgtcactggagtgcagtggtgcagtcttggcttcctgcaccatctgccttccagaatcaggcaattgtccagcttcagcctcccgagtggctgggaccgcagacgtgccaccatgcctggcttatttttttattttttgtggagatggggtttcaccattgttgcccaggctgggctcaactcctgagctcaaagtgatccatctgcctcggcctcccaaagtgctggaattacaggctcagtctatactagtatatttacaactatattttattacaatatttattaaatattgttgtcttttgctaggaaacttaaaaaccttaaagaacatcatttgtgagctcccaattggcacaaattacataaggtactctacacatatttttattttcttaactttttgttataacaagtgaaaaatctaaaaatcaactgaataagcttttatgttgaaaagtatacttaaatgattcttgtgatcatggtgttctagtaagaaaaatgctttgctagtgatgtgacagcgtacggcatatgaataatatttgaaatcttgctactcttttcttatattctgccccaaacccaaaggaagtttaaaatgagaaaaaaggtaaaggtatgaaagaacctttggtgactcaggtggcttcagacttaccagtcacaaaaacttgcaagcaggttctaggagacttcactgcatccatatatgctgttaatagtgttttttttttttttgagacggagtctcactctgttgcccaggctggagtgcagtggtgtgatctcggctcggctcgctgcggcctccgcctcctgggttcaagtggttcttccgcttcagccttacgggtagctgggactataggcacctgccaccatgccaagctaatttttgtatttttagtagagacggggtttcgccatgttggccaggctggtctcaaactcctgacctcaagtgcccactccggcctcccagggtgctgggattgcaggcatgagccaccgcacccggcttgttatagtcttaaaacactctacaccaggggttagtaaacgtttcctataaagggccagatagtaaatattttatgtcactacgcaactctccacggtagcatggaagcagccatagacaatacgtaactgaatgagtgtggtgtgttccggtaacgctttatagacacagaaattcacttaaagtccatataattttcacatgccatgaaatatttactgtttttttttggggggggatggggacagggtctcactgtcactcaggctggagagcagtggcaccatcacggctcggtgtggcctagacctcctgagctcaagtgatcctcctgtctctcggcctcctgagtggctgggatcacaggcatgtgccactatgcccagttaatttttgtgttttttgtagagatggggtttcgccatgttgccagggctggtcttgaactcctgggttcaggcggtccggctgccttggcctcctgaaatgttgggattacaggcgtgagccactgcacccagtgatttaatagatgtaaaaatcattcttagttcttggggcaaataaaacaggcttgcaggccagatttggcctgggaggtatagtgtagactggtccacacgattggagagtcagcaggctcttactctcagacttcctggtggtcctcaccagtctattttacagtggcttctttatttcctttctgccactgttgatgggactgtagcgtcactgcatgtgactgataccaaaagagaaaggttcttttaattaatctttccatactatccagaagatttttttcagttttatttcttaaacatataagagggcattataaaatgacattataattataaaagattttcttttaagaacaatgtttttaggcctactaatattacttaataaaaagagcagatattt

SEQ ID NO: 1078 - DNA, 2622 bp, Homo sapiens
acagatgcggtggcgggcgggtgcagcgagtttgtccccttgcccgcacactgcttggcctctgtacttaagtgcggtggccgcctgcctcgctggagcttctctgccgcagccatccgtgctgcttgggacgggccggggcgcgaaggcggtcgcatccatcgctctgccctcctgggaagtttctgctctccttccccgctcctacccttaggaaaccccctcaccacctgccccagaccaggttcctctgaaccctaaattcaatctttagggcccactttcccaaccccctgacctttttccatcggcacctaccgagacgacttcgtcgcgtgctcccatacccatttctttcactttcctgtggcgagcatctcctttctcagggaaagggaagcatggggccagcaccttgggaagaagaagcgggaagatacgctgccctccctgtctcagatgcacctctggcctcggcgtgaccaccttgtttagctgaggagaagctgggttggcagggttttctgaagtcaagagggagctggggggcgcccggggaggtattggcagttttttcacttgtcctcttctggctttgtagcttctcttgtgtaatcagctgcctatttggaaattgggcagggtttgcgactggatgctaatgtcactgactagttttcagcctaccatccagaagtaacatgttcccagctttggaaacgcacctaaagcagactattcctgatccttatgaagactttatgtaccgtcacctccaatattatggctactttaaagctcagagaggcagtttaccaaactctgctacgcatcagcatgttcggaagaataaccctcaatgcctgttgaatggctctcttggggaaaaagatgatttgataccagacaccctgcaaaaggagaagcttctatattcacatatgctgagtttaccacatcttaggagcagacagcttctttatgatgagttggatgaagtaaacccacgtcttcgagaaccccaagagctcttttccattttgtctaccaagaggccactgcaggctccaagatggccaattgaatgtgaggtcatcaaggaaaacatccatcatattgagtgggctccacctcaaccagaatatttctatcagcctaaaggaaatgaaaaggtaccagagattgtaggagagaaaaaaggaacagttgtctatcaattagattcagtgcctatagaaggttcctattttaccagttccagagtgggaggcaaacgaggaattgtcaaggaacttgctgtcacgttgcaaggaccagaagataatactctactgtttgaatcaaggtttgagagtgggaatctgcaaaaagctgtcagagtagacacctatgagtatgaactcaccttgcgaactgacctctacactaacaaacacactcagtggttttattttcgtgttcagaacaccagaaaagatgctacctatcgcttcaccattgtcaacttgctaaaacccaagagttttatactgtagggatgaagccactcttgtactcccaattggatgccaacacccgcaatattggctggaggagagaaggaaatgaaatcaagtactacaagaacaacacggatgatgggcagcagcccttctactgtctcacgtggaccattcagtttccatatgaccaggacacttgcttctttgcacacttctacccatatacatacactgatttgcaatgctacctcctgtcagtggcaaacaaccctatccagtctcagttctgcaagctccaaactttatgcaggagcctagcaggaaataccgtttacttgctcaccatcaccaacccatcccagacccctcaagaggcagctgcaaagaaagctgtggtcttgagtgccagagttcaccctggagaaagtaatggctcctgggttatgaaaggctttttggacttcatccttagcaactccccagatgcccagctcctcagagatatttttgtcttcaaggtgcttcccatgttaaatccagatggtgtgattgtggggaattatcggtgttccttggccggaagggatttgaacaggcattataaaaccattctgaaggagtctttcccttgtatttggtacaccaggaacatgatcaaaagacttcttgaagaaagagaggttctgttgtattgtgatttccatggccacagtcgtaagaataatatcttcctgtatggctgtaataacaacaatcgcaaatactggcttcatgaacgagtctttcctttaatgttatgcaaaaatgcaccagataagttctcttttcacagttgtaattttaaggtccaaaaatgcaaagaaggaacaggacgagttgttatgtggcggatgggaatcctaaacagctacaccatggagtctacctttggcgggtccaccctgggtaataaaagagacacccactttaccatcgaagatctgaagtccttaggttatcatgtctgtgacacccttctggacttttgtgatcctgaccaaattaagcaccagtggctctgacagttctctctcagatggtcttcctgttcacctagcaaacatagcagatgagctgactc

SEQ ID NO: 1079 - DNA, 3190 bp, Homo sapiens
atctgttcagctctgctattcaatcaggaaggctcctgtagacaatatacccatgaatggtgtagtgagttctaatgaaactttatttacaagaggagactgaccaggtttggcctgggggccacagtgtgtagacctctggaaagatacatcctgagaagaaaaaaagaatatatgcaggaatgcttaactttgtgggttttctctcctcttgccctcactgactcaggatacacaaagacctatcaagctcacgcaaagcagaaattcagccgcttatggtccagcaagtctgtcactgagattcacctatactttgaggaggaagtcaagcaagaagaatgtgaccatttggaccgcctttttgctcccaaggaaactgggaaacagccacgtacagtgattattcaaggaccacaaggaattggaaaaacgacactcctgatgaagctgatgatggcctggtcggacaacaagatctttcgggataggttcctgtacacgttctatttctgctgcagagaactgagggagttgccgccaacgagtttggctgacttgatttccagagagtggcctgaccccgctgctcctataacagagatcgtgtctcaaccggagagactcttgttcgtcatcgacagcttcgaagagctgcagggcggcttgaacgaacccgattcggatctgtgtggtgacttgatggagaaacggccggtgcaggtgcttctgagcagtttgctgaggaagaagatgctcccggaggcctccctgctcatcgccatcaaacccgtgtgcccgaaggagctccgggatcaggtgacgatctcagaaatctaccagccccggggattcaacgagagtgataggttagtgtatttctgctgtttcttcaaagacccgaaaagagccatggaagccttcaatcttgtaagagaaagtgaacagctgttttccatatgccaaatcccgctcctctgctggatcctgtgtaccagtctgaagcaagagatgcagaaaggaaaagacctggccctgacctgccagagcactacctctgtgtactcctctttcgtctttaacctgttcacacctgagggtgccgagggcccgactccgcaaacccagcaccagctgaaggccctgtgctccctggctgcagagggtatgtggacagacacatttgagttttgtgaagacgacctccggagaaatggggttgttgacgctgacatccctgcgctgctgggcaccaagatacttctgaagtacggggagcgtgagagctcctacgtgttcctccacgtgtgtatccaggagttctgtgccgccttgttctatttgctcaagagccaccttgatcatcctcacccagctgtgagatgtgtacaggaattgctagttgccaattttgaaaaagcaaggagagcacattggatttttttggggtgttttctaactggccttttaaataaaaaggaacaagaaaaactggatgcgttttttggcttccaactgtcccaagagataaagcagcaaattcaccagtgcctgaagagcttaggggagcgtggcaatcctcagggacaggtggattccttggcgatattttactgtctctttgaaatgcaggatcctgcctttgtgaagcaggcagtgaacctcctccaagaagctaactttcatattattgacaacgtggacttggtggtttctgcctactgcttaaaatactgctccagcttgaggaaactctgtttttccgttcaaaatgtctttaagaaagaggatgaacacagctctacgtcggattacagcctcatctgttggcatcacatctgctctgtgctcaccaccagcgggcacctcagagagctccaggtgcaggacagcaccctcagcgagtcgacctttgtgacctggtgtaaccagctgaggcatcccagctgtcgccttcagaagcttggaataaataacgtttccttttctggccagagtgttctgctctttgaggtgctcttttatcagccagacttgaaatacctgagcttcaccctcacgaaactctctcgtgatgacatcaggtccctctgtgatgccttgaactacccagcaggcaacgtcaaagagctagcgctggtaaattgtcacctctcacccattgattgtgaagtccttgctggccttctaaccaacaacaagaagctgacgtatctgaatgtatcctgcaaccagttagacacaggcgtgccccttttgtgtgaagccctgtgcagcccagacacggtcctggtatacctgatgttggctttctgccacctcagcgagcagtgctgcgaatacatctctgaaatgcttctgcgtaacaagagcgtgcgctatctagacctcagtgccaatgtcctgaaggacgaaggactgaaaactctctgcgaggccttgaaacatccggactgctgcctggattcactgtgtttggtaaaatgttttatcactgctgctggctgtgaagacctcgcctctgctctcatcagcaatcaaaacctgaagattctgcaaattgggtgcaatgaaatcggagatgtgggtgtgcagctgttgtgtcgggctctgacgcatacggattgccgcttagagattcttgggttggaagaatgtgggttaacgagcacctgctgtaaggatctcgcgtctgttctcacctgcagtaagaccctgcagcagctcaacctgaccttgaacaccttggaccacacaggggtggttgtactctgtgaggccctgagacacccagagtgtgccctgcaggtgctcgggctgagaaaaactgattttgatgaggaaacccaggcacttctgacggctgaggaagagagaaatcctaacctgaccatcacagatgactgtgacacaatcacaagggtagagatctgattgcgaggaacctgggctctgactcgaacacctgcaaaggacagggactgggaccgttacttacatgacactgcacccaggagatacaaatcattgacactctgagttgtgagatttctggcaccccattcatagatttgatatgatacacgtggtttttatgtgctctgtggccttggatgagtcactgaaaggccttcatggtctctcggtctcacaaggacctcttaacccctcaataaagtgttacatttct

SEQ ID NO: 1080 - DNA, 3325 bp, Homo sapiens
gaagttaagtgatgtccctgtttgcagtgtcaatgagattgagggcttgggcttgaacccaaccttctccctccaaatagcctgctctttctgttatgtcatgtttcatatacaagtttgggagcctccagccctgactatcccaacatatacaacataatgtatatgttgtctttggaaatatcttctgtgaaggccaagcatttaatattacaggaaaccttgaagtggatatggaagcttggcagccagcttggatcttcctaagagcctctttccttcataccatcttcagattgttattccgtgacatcttatctacttaagcagctaacccatgaggcatccaaaacagagagaaaaaacagagtgaacattttgccttatggaattgtcaaaagttgcggtcgaaacacaggcaagatttggaagaatctgtaatgagccagggccagttttcctagttatagagcctaggctggaggaggtacatgggctggggaaggagagggaattagagattggctgttcctggaaactctctgcctgtactccatggcctgagtcccaggacctggaagcggctgaaaatctgagatatagaagagactggtgctgcctttctggggagggcttgggaaaacagcaagttccctgaatttttccatggcacaggagcagatgaaatgtcatgattggtgtccaggctagtggactgagttaactcccgagagtccctgtactctccagcatggcacgaggagaagcaaaccattttcctatgcagccataggaaaacggtacaaacacgacactgaaattcagctgaccgcaagagcttgatggtcagtgtgagccagatggagcaggaacatgtatggatggaaaacccagatccaaagttcatccccctctcccgtggatgctccagcacattgcaaggtttcccagaaacttagaggcaaccttggcacaaggacatgatttgttggaaattaagttttgtcacctgggggactgcgagcttgatacggaaattaattcagttatataattataaaaatgatgcgctttctacacatctgattttgtgaacccaaattagtttccacaacgcaactgtgttaacatttgccaacctctggggcaacattggttgtctttgttgcttttttctagaagttttcagctcgaactcatctttcccttttttattttcatttctaaattctggtgagtggtgttttgataagtagatatcagctatttcctgtcttacttgaaaagtcttctctgtattaaataacaaaggtcacttagataaatatcttctcattaccagagggtagggaactgcttctcctatacataacttctattatctttcaatccagaaaaaaaaacgtggcaggaggacaagtttttgaatgttatgaatcgtgatttctgtgtctaaaatctgctcttttgttaacactaagggcaacttccttcaaagtggttcatcttggtctattagtgtgtttgtgtgtgtgtgtgtgtgtgtgtgtgtgtagtaaaaccaaagtttcctattatttttgaaggtatttggccctgctggaagacagctatgtataagttgaacttggcagagagaaagggaaaccagatcttactcccaggcctcctgtcaccagctgtgtgactttgctgaagtcatttctttcccctaagtctcagttccaatacctataaagtgagtgttctgcctgtgtgtgttttaggtctttattaatgttgaaatgtcctgactttatgggttctcattcactgtgatgtggtaaccaaaacaagcagagattaataaccaggactcaataatgtaaaacactaaaaattatatttttgcaaatttttgtaaacgcgggatcatatctctctcagtgacagtattggtgtgatccattattgtacatttagtggataaacagaatgtaactaagaagtgttatctttgttatcaggggaacgtggagttggatgtgtatgatggggatgggcgttaattcataggttaaacactcaacgagggaatatctctttatcgctatctccaaagactccccactcttcctcaattttcttagtaactcactgctcagacttagtttccccagaagcagactatgagaccaggatttgatgcaagcagtttttttggagttgatctcagaaaggctaagagagtagagaagtaatacagagaagtgaagaaagctaatagaaggtcccggtgctctctcctgaaagagagcgctggaagactgagtagaacatgccccagagttgtccccctctgctggggcaagagagctagggtactgatcagctaatttccgtgcttcactggttaagggcattaacctccccaaacttctggcctgtgccccagatagaccaggcatgcttctgtggccagagaaagcccgaggatggagagtcacagatgcttgtggtaggtagcaggtggtgtgtatggaaatgggaatgggatgccaaggggatttgggcagggcaccaagcatctgccgcattaccctaatccaggcaataacactcacagtatcccagggattccccttctagcctcgaattcctcttattctcatttattttgtatttactttctagaccatagtttctcagatagtaaaggttctactgactttcctcatctctctgcaacctctttcctgcttagcttctcttccatggtcaagccaatacacacagaattttgccttccattcttcactcaggtgtttcttccacttggaatctgttcctcagtcattttcactaatccatgtccctcccagtacacagaatttttcacagaaaacatagttaatcctttaaaaatatatttagattgacttgcatgcccctcttaaggttttttctttccaaatgccttttttaaaaccccaatttaagaatttctttagccaatactacaacaatgcagtccttgttctccacttctttccttttatctactcaatgttattaatctttttagtgtaaacatcagtaactcaagcgagccttttctgatccccatgattaggatgagtttttgtgttgcctactccaaaaggtctgtcctttttaatgctcaccacacttgaggtttctgttcacacttcaaaggctgtggggcccgataccatgattttgctgcactcctagacctggcctactggtacatagtaggcattgataaaaatttgctggagcattgcataaataaactatgccatttggggctgattaacatttt

SEQ ID NO: 1081 - DNA, 3233 bp, Homo sapiens
tttttttcgcccccgcccagcggccggatcgcatctcagctggttggctttggttagagctcccgtcagactttcgttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtttacaaaagatactgcaaggttcaaggatgagttagatatcatgaagttcatttgtaaagatttttggactacggtattcaagaaacaaatcgacaatctaaggacaaatcatcagtatttagcatttacgtgtggcttaatcagaggtggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcagggcccttattttaaacctttttatttggttagagtgatatgtatttagccatagatggagaaacaaagctcagggtttgttgaattagcatgagagaaaattatgtaccaacagaattatttgtgagaagaatgaacaaattttgataaagtatgaatttgttttattttaaaaagcaaacatactaaattttttttattttattgcttataatttattaagaatgtttacacctgtataaggatttcatatatacattgtatgtgtgtatatataaatacatatatgactgcctaaattgtttataaatttaatttttctttaataggtttcattccttcagagctccattaatgtaatcaaaatgaaatatagattagtttaaatgtgaattcagtgactctagggccaaagaatattaggtatgtttggaaagaatttttgtatttattcctgttacagttttgactttcaacttctctccccgtgcatggaagtcctggtaaaggatctaacatctttattcccttctttcctcttccagctgagcagagttggataattgaattagtcattctgacattctttggaccatatcatcttagtggtttggggtcagtgctcatctgataaatctttcttaccacctcttctacttactttctcttacttaaattatctggcataagcagttatctccagcttttgttagaatcttgcatgttgattactaaaactatactttgtttcccatttatttattacccttttgcatgtatttgtgtgacagggaactctgcagcagggggtgactgacacaccaaacaagatgtttcactgggtactctgccatagaaatggcagattaagaagattgactataccaaacattatattaaaaacacaaaataaaaactataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctactaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctacccatcagccatttcgttctcccttccttgctgacaaagccccattttttttttctttttttttggcctaaaactctgtatggctgccttgtgctatagaatagggtgcttccctagcctagagagggtgagtgttgattagattctgtgccaatcatggtaattggcttacttgatcatttgatggaatctaggctaacgagacaaaggaagtctgaaggctttgaataagaaattttctgttgctcttaacaattgatacaagttagggatttgccagcatccctcttctgcttctcagtgaagatatgtgatatggatgtttgaagctaatctgcaacagccttctgatggccatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacaattgaatatgcctttttctgcgggagtaggtggggagaaacttaaaggttcacttgtaaaacaataaagtactaaagaaaatgtg

SEQ ID NO: 1082 - DNA, 2898 bp, Homo sapiens
gttttgcgtttgaacctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggtgaggcggcggcggaggtgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgcggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcggcctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaagtaaactggtggtgggaaatggaccagagggtccaggtctgtcaagcacaggcaagaggagggccacaggccaggactcttgtcaagagagagggcttcaagaggccgtccggagagagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcactcttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccgtccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcgcagtggcgtgtgcctgtagtcccagctactcgggaggctgaggcaggaggatcgcttgagcccaagagttcatatctagcctggtcaacatagcaagacccctgtctctatttttttaaataaataaactacatgtgaaaacaaacgtttatatttataaaccctcttttttttttttttaattttattgagacagagtcttgctctgtcacccaggctagagtgcagtggtgcgatctcagctcactgcaacctccgcctcccgggttcaagcaattctcctacctcagcctcccgagtagctgggattgcaggcatacaccaccatgcccggctaattgtttgtatttttttagtagagatgggggtttcaccatgttggccaggctggtctcgaactcctcaccttgtgatccacccacctcggcatcccaaagtgctgggtgattacaggagtgagccatggcacctgaccttaagccctctttctaattgtcagcagagtcctttctgtaaattcctttccgttttttgagccttaacacttatgtagtctgagcaaaaaaaaatgcccaggcttcagcttcatactgagcagagcctgttgcttcaggtatcaaggctagctttgggaaccagactacagatgagacaactgaaagcaaagaggctgaggcaaagcagagaccaaaaaagagtctcaggggagaagaagggaagctagtaagcaacttatagggggcagtgtaagaaatgtcacatgttacatcactcacacagagaagcagaatttatcaattttcaaagggaaaatgtctctgtctactgacaaggttttaatttttgcttttttttttttttgagatggagtctcactctgtctcccaggctggagtgcagtggcaggatctcggctcactgcaagctccgcctcccgggctcacaccattctcctgcctcagcctcccaagtagctgggactacaggcgcccgccaccacgcccggagaattttttgtatttttagtagagacggggtttcaccgtgttagccaggatggtctcgatctgctgaccttgtgatccacccgcctcggcctcccaaagtgctgggattacaggtgtgagccaccgcacctggccaatttttgcttatttttcctcaaagggaggaaaactgacaggttgctttaagagctgagtgattgagagtccttctgaacaggacttcgggaatttactcctaatcttttcccatggttaacttgccttcactctgtttctagaactctggtttttatacttgagactctgtagtcactgtggaaagaggtgtgactgataaagaactgcctttaaat

SEQ ID NO: 1083 - DNA, 2256 bp, Homo sapiens
aaaaaaggcagagaggaaaggcgaggggtgttgacgccaggaaggttccatcttggttaagggcaggagtcccttacggacttgtctgaggaaagacaggaaagcgccagcatctccaccttccccggaagcctccctttgccaggcagaaagggtttcccatggggccgcccctggcgccgcgcccggcccacgtacccggggaggccgggccccggaggacgagggaaagcaggccgggcgccgtgagcttcgcggacgtggccgtgtacttctctcccgaggagtgggaatgcctgcggccagcgcagagggccctgtaccgggacgtgatgcgggagaccttcggccacctgggcgcgctgggattttcagttcccaaacccgcttttatctcgtgggtggaaggagaagtggaggcgtggagcccggaggcccaggatcccgacggatccagggatgggaatgaggagaaggaaaggctgaagaagtgtccaaaacaaaaagaggtggcgcatgaagtggctgtcaaggagtggtggcccagcgtcgcctgcccagagttctgcaaccctaggcagagccccatgaatccctggctcaaggacactctgacccgaagactgccccactcttgcccagactgtggccgcaacttcagctacccttccctcctggccagccaccagcgggtccactccggggagcggcccttctcctgcggccagtgtcaggcgcgtttctcccagcgcaggtacctgctccagcatcagttcatccacaccggcgagaagccctacccctgccccgactgcgggcgccgcttccgccagaggggttccctggctatccacaggcgggctcacaccggggagaagccttacgcgtgctcagactgcaagagtcgcttcacttacccctacctgctggccatccaccagcgcaagcacacgggcgagaagccctacagctgccccgattgcagcctccgtttcgcctacacctccctgctggccatccacaggcgcatacacaccggcgagaagccctacccctgtcctgactgcggccgccgcttcacctattcttccctcctcctcagtcaccggcgcattcactccgacagccggcccttcccctgcgtggagtgtgggaaaggcttcaagcgcaagaccgccctggaagcccatcggtggatccaccgctcctgcagcgagaggcgcgcgtggcagcaggccgtggtggggcgttcagagcccatccctgttttgggaggcaaggatcccccagttcacttccggcactttccagatatatttcaagagtgtgggtgatggcgttcacacaaactggtcagcgtttccctggagaggaagaggcaagatctgctagccctacttttgaagaggaaacttttgaaggaatgaacaaaagaggtaggtgggactaagcatttctgcattccaggactggtggtcagtgactcaaatatctctttgaaaagactgcttctttgaatccttgggttccaagataattaatgggaactggtgccgggcacggtggctcacacctgtgatcccagcactgtgggaggctgaggctggttaatcacctgaggtcaggagtttgagaccagctgggcaatatagtaaccccatctctaccaaaaaattagccaggcgtggtggcacatgcctgtagtcccagctactcaggaggctaaggcaagaggatcacttgagcctgggagacagaggttgcagtaagctgagatggctccattgcactccagcctgggctacaaagcaggactctgtctcaaaacaaaaacagatacaaaaactgggaacggggtgttatctttacttcaccacatagcctctcctgaattggtggacctggattcctagcttggctcagtccccactggctgtgtggcctttagcatcacctagattctacaaataacatttttctctatttgttttacacatgtcaatctgcctatccatccctctatccattcatttatccattttattaatgtatttcaaagtaagttgcagacatcattacatttcacttctaaacacttcagcatacagctgagttttatgcaagaaacttaagctctcagctgggtacagtggctcgcacctgtaatcccagcactttgggaggctgaggcaggaggattgcatgagattgggagtttgagacgagcctggaaaacagcaagacctcatttctact

SEQ ID NO: 1084 - DNA, 2239 bp, Homo sapiens
ggcttccgggtttggcgggtactttgtctctcgctctagccggagctgcaggtctcgtcttccctggtctgtgtcctcttctcctaggggcccagcctctgtggccctgtgacctgcaggtattgggagatccccagctaagacgccaggtcctcctggaagcctagaaatgggaccactgacaattagggatgtgactgtagaattctctctggaggagtggcattgcctggacactgcacagcagaatttatatagggatgtgatgttagagaactacagaaacctggtcttcctgggtattgctgtctctaagccagacctttgcccagagcgagacataaaatattttttccaaaaagtcatactgaggagatatgataaatgtgaacatgagaatttacaattaagaaagggctgtaaaagtgtggatgagtgtaaggtgtgcaaaggaggttataatggacttaaccaatgtctgataactacccagagcaaaatgtatcaatgtgataaatatgtaaaagtcttctataagttttcaaattcagatagacataagataagacatactgaaaagaaaacttgcaaatgtaaagaatgtggcaaatcattttgcatgctttcacaactaactcgacataagagaattcatattagagagaattcccacaaatgtgaagaatgtggcaaagcctttaaccagtcctcagctcttactcgacataagatgactcatactggagagaaaccctacaaatgtgaagagtgtggaaaagcttttaaccggtcttcacaccttactcaacataaggtaattcatactagagagaaaccctacaaatgtgaagagtgtggcaaagcctttaaccggtcttcacacattactcaacataagagaattcataatagagagaagcccttcaaatatgatgaatgttgcaaagcctttaagtggtcctcagctcttactacccttactcaacataagagaattcatactggagagaaaccctacaaatgtgaagagtgtggcaaagcctttaaccagtcctcagcccttactcgacataagatgattcatactggagagaaacccttccaatgtgaagagtgtggcaaagcttttaaccggtcttcacaccttactcaacataagataattcatactaaagagaaaccctacaaatgtgaagagtgtggaaaagcctttaaccggtcttcacaccttactaaacataagagaattcatactagagagaaggcctacaaatgtgatgaatattgcaaagcttttaactggtcctcagctcttactacccttactcagcataagataattcatactggagagaaaccctacaaatgtgaagagtgtggcaaagcctttaaccggtcttcataccttattcgacataagataattcatactggagagaaaccctacaaatgtgaagagtgtggcaaagcctttaaccagtcttcacaccttactcaacataaaataattcatactggggagaagccctacaaatgtgaagaatgtggcaaagcctttaaccggtcttcacacctttctcaacataagataattcatactggagagaaaccctacaaatgtgaagaatgtggcaagccttttaatcgtttctcataccttaccgtacataagagaattcatgctggagagaaccccaacaaatatgaagaatgtggcaaagcttgtaaccattcctcaaaccttactaaacataattcataatggagaaaaaccctacaaatgtgaagaatgtgtcaaagcttttaactgttcctcaatccttactaaacataagggaattcataatagagaaaccctacaaatgtgaagaacgtggcctggcttttaacaaatcctcaacatttactaagcataaaataattcatgctggagagaaactcttgaaatgtgatgaatgtggcatagcctcttcccagttctcaactcttactaaacatgagaacacatgtggaagataaagcctacaaatatgaagaatgtgacaaggcctttaaaagttctcaacccttattacacataatttatactggacagaaatcctaaagtgtgaagaatgtcacaaagcccttaataagtcctcaattcttaacagatataagatgtttcatactggagcgaaactacaatcctgaatgatgtcacagtgcttttaacaatacctcaaacttttctaaacat

SEQ ID NO: 1085 - DNA, 2334 bp, Homo sapiens
aacattcaagatgtcattctactgagaaaccctataaatgtaaggaatgtgggaaagccttcagacgagcctcacacctaacacaacatcaaagtattcatactggtgaaaaaccctatgaatgtaagcaatgcgggaaggcctttagtcgtgattcacaactcagtcttcatcagagacttcatactggtgagaaaccctatgcatgtaaggaatgtgggaaggcctttactcaaagctcacaacttattttacatcatagaattcatactggtgaaaaaccatataaatgtgaagaatgtgggaaagcctttattcgtagctcacaacttacccgacatcaaaaagttcatactggtgagaaactttatgaatgtaaagaatgtgggaaggcctttactcagaattcacaacttacactacaccagagacttcatactggtgaagagctctatgaatgtaaagaatgtaggaaggtctttactcagctctcacaacttattctgcataagagaattcataccggtgagaaaccctatgaatgtaaggaatgtggaaaagcttttatttgtggctcacagctttctcaacatcagaaaattcataatggggaaaaaccatatgaatgtaaggaatgtggaagggcctttattcggggctcactactgatgcaacatcagaggattcatactggtgaaaaaccctataaatgtgaagaatgtgggaaggcctttatccgtggctcacaacttactcaacaccagagaattcacaccaatgaaaagccctatgaatgtaaggaatgtggaaagatgtttagtcatggctcacaacttactcaacatcagagaatacacactggtgagaaaccctatcaatgtaaggaatgtggaaaagcgtttaatcgtggctcactccttacacgacaccagaggattcatactggtgagaaaccctatgaatgtaaagaatgtggaaaaacctttagtcgtggctcagaacttactcaacatgagcgaattcacacaggtgagaaaccctatgaatgtaaggaatgtgggaaatcttttattcgtggttcccagcttactcaacatcagagaatccatactggtgagaaaccttatgaatgtaaagaatgtagaatggcctttactcagagttcacatctttcccaacatcaaagacttcacactggtgagaaaccctatgtgtgtaatgaatgtggaaaggcctttgcgcgtggcttactacttatacaacatcagagaattcatactggtgagaaaccatatcaatgtaaggaatgtgggaaagcctttattcgtggttcacagttgactcaacatcagcgaattcacactggagaaaaaccctatgaatgcaaggagtgtggcaaggcctttagtcatggctctcagcttactctacatcagagaatccatactggtgagaagccctatgaatgcagagaatgtagaaaggcctttactcagagttcacatctttctcggcatcagagaattcatactggtgagaaaccatatcaatgtaaggaatgtgggaaggcctttactcgtggttcacagctaactcaacatcagagaattcatatcagtgagaaatcttttgaatataaggaatgtgggattgactttagtcatggctcacaagtttacatgtgaattgtctgattatttgagatcactatgaagaggttctctggttgttagcagcaaagaattctcacaaatgtgaatatgggcgcacatttgcctcataaagcacagcatcagataatttatgtgagagaaaatggtagtgtcattcatatagaaaaacatcattactggaaacctattaaacattagcaaattggagaatagttttaatatagtaaatgtaggaagccctttagccatattgaaaacaaatatctttttcaacgttatcttagctctactagttgatcattttgttatatgtatcatgatacttaacctctaccttggtttaatcattttaagatagacctaagtatattacctttattgtaagattcttggaagtattatgtaagttattacatgtaaaagctcttagaatggtgccttgaacgtagcataccacaaatattagctaccattttcactagtgttattttagagaatttgcatgagaggagagtacttatgagtataatgaatattgagaaatcttttatcaacacatccaagatgacttggttggggggccctgtatgccataatgaatgtgagaaagctgtcatttaaatctcatccattattgctataagaggaaattcatactgtt

SEQ ID NO: 1086 - DNA, 2180 bp, Homo sapiens
caacttccctcctatgtctggagagtgatcactttcactcccaaagacatcctttggtgatacttactgtgggattcagagtggggtgcagaggacgaccctgcaaaggcacggactataagagagatctgtgcagctgcgcctcagggggtgtcctgggcccctgggcatgacaggagggggaccacttgcagttctactggaaaatttaccacccttccagaatcctctgaagatatacaggtcgcaactagagtgagacccgagtactgccttgggtcagaatggctagagaaccgagaaaaaacgcagccctggacgcccagtctgcagaagaccagacggggctcctgaccgtgaaggtggagaaggaggaagcctccgccttgacggcggaggtgagagcaccctgcagccctgctcggggccccgaacgctcccgccagcgcttccgaggcttccgctacccggaggctgcgggcccccgcgaggcgttgagccggctccgagaactctgcggacaatggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtagaaagaacaggtttagtatctgagcgctgtggtctgtttcctcctgaaatcccagatcggagcgaggggcattcctttaaggtccaggagttcttcatctctttttgtactgtgaacctccttggcagtaaggtgaagtccctggactccttctcagaattatatttttaaatatataaagaaactataaaggattacaaaagaacacaactatattgacatacagttagcaaagaattaaatttgtattaaagtcatatatgtggatttttattactgcactaaataataagacctagggacagggcttataattggcaatttcaaaatggcgataagcatctatttgcctggttgtaatgtggtgtgaaaacgtgcaggttttgttggtgacaaagtcctgggtactgcttatgctaccttgatttgttgcttccattcataattgaaggaaatgttaactctctcttaaagaccagtaaaaataagattagtttttgtcctttctaagttcatggaccacttgggagaaagtccatggaccactggttatgaacctctggtagaaagtgggcctatttttacctccatgttcttccctgttttatgagggactgtttcccctttgcatcgtcctgtgtccctgtgcacacaacttcagaggacctgtgtggccaaatcttctaactggtgagctggataccaaggttcttgacttaggtctattgcacgcaagccctgtagcagtgggaagtcattgcaaatctcttagcttcattcttcataaaatatgtgggaaattctgagctgcacgtgagacagtaacttgaaaactgtaatttaactatcaatgtctggaaggaaacctgcttttaatgaggacataactatgtgccaggccctgtgttaggtgatgtcacatactgtgatcttatttactggtctccaaaacctcataaagtagaaattattatcctcatttttcagattagaaaatatattagtattgagaatttagcaccagtgtccaaagggttttcgtaaacacacagatgtatataatgagggagcctagagtaatggtaagaacacgggatctggagtcattctgtctgagctcccatcttagcatttccacttattagctgggtgacatgggcaagctgcttaaacactgtccacccttggctgggtgcagtggctcacgcctgtaatcccagcactttgggaggctgaggtgggcggatcacctgaggtcgggagttcgagaccagcctgaccaacatggagaaacccggtctctactaaaagtacaaaacattagccgggcgtggtggcacatggctgtaatcccagctactagggaggctgaggcaggagaattgcttgaaccccggaggcggaagttgcggtgaggtgagatcatgccattgcattccagcctgagcaacaagagtgaaattccgtctc

SEQ ID NO: 1087 - DNA, 2173 bp, Homo sapiens
aacaaaagtgtctgagaaagccagagtgtgaccacgcggtttctatgctccaagggatttatttcagtggtaggtggagcagctctgtggagcacatggctaatgataatggattgactgaccagaagcaggagaggacctagcagaagccggaggtcaagctgccccaagactgggggacagcctgggtgaagactctggacctcatgaccatgtatattccagagggggatctaaagagccccagaaattcacaaaggaccagtcctgcctctgttgtagaagacatgtggtgtatataaagtttgtgatcgttggcggaaattttggaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcagccgggggccaaggactcaccgtctttggaggtgtgaactcttcgtctcatacggggaccttgcgtacgagaggaggaacaggagtgacactctttgtggccctttatgactatgaagcacaggcagaagagtggtactttggaaaacttggccgaaaagatgctgagcgacagctattgtcctttggaaacccaagaggtacctttcttatccgcgagagtgaaaccaccaaaggtgcctattcactttctatccgtgattgggatgatatgaaaggagaccatgtcaaacattataaaattcgcaaacttgacaatggtggatactacattaccacccgggcccagtttgaaacacttcagcagcttgtacaacattactcagagaaagctgatggtttgtgttttaacttaactgtgattgcatcgagttgtaccccacaaacttctggattggctaaagatgcttgggaagttgcacgtcgttcgttgtgtctggagaagaagctgggtcaggggtgtttcgctgaagtgtggcttggtacctggaatggaaacacaaaagtagccataaagactcttaaaccaggcacaatgtcccccgaatcattccttgaggaagcgcagatcatgaagaagctgaagcacgacaagctggtccagctctatgcagtggtgtctgaggagcccatctacatcgtcaccgagtatatgaacaaaggaagtttactggatttcttaaaagatggagaaggaagagctctgaaattaccaaatcttgtggacatggcagcacaggtggctgcaggaatggcttacatcgagcgcatgaattatatccatagagatctgcgatcagcaaacattctagtggggaatggactcatatgcaagattgctgacttcggattggcccgattgatagaagacaatgagtacacagcaagacaaggtgcaaagttccccatcaagtggacggcccccgaggcagccctgtacgggaggttcacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgccccatctctctgcatgagctcatgatccactgctggaaaaaggaccctgaagaacgccccacttttgagtacttgcagagcttcctggaagactactttaccgcgacagagccccagtaccaacctggtgaaaacctgtaaggcccgggtctgcggagagaggccttgtcccagaggctgccccacccctccccattagctttcaattccgtagccagctgctccccagcagcggaaccgcccaggatcagattgcatgtgactctgaagctgacgaacttccatggccctcattaatgacacttgtccccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttcctttttttaaaaatgcaaatcctatgtgattttaactctgtcttcacctgattcaact

SEQ ID NO: 1088 - DNA, 3386 bp, Homo sapiens
gacaaagctcccggaggtgggagccctgggccaaaatggcggcctacctgcagtggcggcgcttcgttttcttcgacaaggagctggtgaaggagccgctgagcaatgatggggccgctcccggggccacacctgcttctggatccgctgcttccaagttcctttgcctccctcctggcatcactgtctgcgactcaggccgagggagcctggtctttggagatatggaaggccagatctggttcttgccacgttccctacagcttacaggcttccaagcctacaaactacgggtgacacacctgtaccaactgaagcagcacaatattctggcatctgttggagaagatgaagagggcatcaaccccttggtttcacagatggcagtgttacattgaacaaaggagacatcacccgggaccggcatagcaagacccagattttgcacaagggcaactatcctgtaactggattggcctttcgccaagcaggaaagaccactcacttgtttgttgtgacaacagagaacgtccagtcctatatagtttctggaaaagactaccctcgcgtggagttggacacccatggttgtggcctgcgctgctcagccctaagtgacccttctcaggacctgcagttcattgtggccggggatgagtgtgtctacttgtaccagcctgatgaacgtgggccctgcttcgcctttgagggccataagctcattgcccactggtttagaggctaccttatcattgtctcccgtgaccggaaggtttctcccaagtcagagtttaccagcagggattcacagagctccgacaagcagattctaaacatctatgacctgtgcaacaagttcatagcctatagcaccgtctttgaggatgtagtggatgtgcttgctgagtggggctccctgtacgtgctgacgcgggatgggcgggtccacgcactgcaggagaaggacacacagaccaaactggagatgctgtttaagaagaacctatttgagatggcgattaaccttgccaagagccagcatctggacagtgatgggctggcccagattttcatgcagtatggagaccatctctacagcaagggcaaccacgatggggctgtccagcaatatatccgaaccattggaaagttggagccatcctatgtgatccgcaagtttctggatgcccagcgcattcacaacctgactgcctacctgcagaccctgcaccgacaatccctggccaatgccgaccataccaccctgctcctcaactgctataccaagctcaaggacagctcgaagctggaggagttcatcaagaaaaagagtgagagtgaagtccactttgatgtggagacagccatcaaggtcctccggcaggctggctactactcccatgccctgtatctggcggagaaccatgcacatcatgagtggtacctgaagatccagctagaagacattaagaattatcaggaagcccttcgatacatcggcaagctgccttttgagcaggcagagagcaacatgaagcgctacggcaagatcctcatgcaccacataccagagcagacaactcagttgctgaagggactttgtactgattatcggcccagcctcgaaggccgcagcgatagggaggccccaggctgcagggccaactctgaggagttcatccccatctttgccaataacccgcgagagctgaaagccttcctagagcacatgagtgaagtgcagccagactcaccccaggggatctacgacacactccttgagctgcgactgcagaactgggcccacgagaaggatccacaggtgaggcctggccagggcttcaggagaaaagacagttcgtgccgtctccattcttccgtcttggtggctgcctttcactgcattccttagaccagtaacaccttacctcggggctcaatggtcctctgtgaagagggaatggactgagggaaagagttgactggctttgtcccaagagaccttgtgattttccccttttgtccagcagctctgccctccttcctctccaggtcaaagagaagcttcacgcagaggccatttccctgctgaagagtggtcgcttctgcgacgtctttgacaaggccctggtcctgtgccagatgcacgacttccaggatggtgtcctttacctttatgagcaggggaagctgtaagagtttggggaatttcagggaaaggggaagaatccaagtcattttccagagacagccactgaggtgtgcccttgccccggccgcaggttccagcagatcatgcactaccacatgcagcacgagcagtaccggcaggtcatcagcgtgtgtgagcgccatggggagcaggacccctccttgtgggagcaggccctcagctacttcgctcgcaaggaggaggactgcaaggagtatgtggcagctgtcctcaagcatatcgagaacaagaacctcatgccacctcttctagtggtgcagaccctggcccacaactccacagccacactctccgtcatcagggactacctggtccaaaaactacagaaacagagccagcagattgcacaggatgagctgcgggtgcggcggtaccgagaggagaccacccgtatccgccaggagatccaagagctcaaggccagtcctaagattttccaaaagaccaagtgcagcatctgtaacagtgccttggagttgccctcagtccacttcctgtgtggccactccttccaccaacactgctttgagagttactcggaaagtgatgctgactgccccacctgcctccctgaaaaccggaaggtcatggatatgatccgggcccaggaacagaaacgagatctccatgatcaattccagcatcagctcaagtgctccaatgacagcttttctgtgattgctgactactttggcagaggtgttttcaacaaattgactctgctgaccgaccctcccacagccagactgacctccagcctggaggctgggctgcaacgcgacctactcatgcactccaggaggggcacttaagcagcctggaggaagatgtgggcaacagtggaggaccaagagaacagacacaatgggacctgggcgggcgttacacagaaggctggctgacatgcccagggctccactctcatctaatgtcacagccctcagaactaaagcggactttctttccctgccttcttatttagtcagcttgccatccctcctcttcactagcagtgtagatcattccagatcagtgggggagggcacctcagcaacctctgagtgtggacaatagctgctttcttctctatccaagagcaccaggctgtgcttgggtccttgctctcagagtctataaataaaagaatataatg

SEQ ID NO: 1089 - DNA, 3440 bp, Homo sapiens
agttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgctcttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagagcaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgacgctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaagctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttg

SEQ ID NO: 1090 - DNA, 3140 bp, Homo sapiens
agtcgcatgcaggacagcaccgcgtgcggcagctgctctggtggcctcctgcttacccggccctccactttaccgttagcacggagtgcggcaccctgcttgggcctttcggctctgcctcccctgcccgtcacggcgggtcacgacatcggccaggacgcagcagaagggacaagacacgcaaagaagatggcgcacccacctcggcaccgaaggccagtgcgacctcccgggagcaggcgggccagcatgggccttcccggaggagacagctaagccgagacctgggactgcagaggagaaacaaggaggaggcaggcggggcccggtgccctcctcgtctgccgtgccgggtggacagtctgctcgcctgtctgcgtgacgaaaccgaggcacagagacgcgctatgccagcggcgggtatagcaagggctccctccgcgccacgtgttgccatccaccacacaggaatgaccgtctccgtgtcatagatgggaaaccaggacgtgtaggcatcagggtttctccattttggccagactggtctggaacttctgagttcaagcggtcctcccgtctcagccttccaaagtgctgggatgacaggtgtgagcagctgcgccctgcaggtgcaggccctggaagacaagggaggagcctgtgagccaccggcccacgtgaaagtaaatgcatgaagttccctctcgctgaactgaaaagagcctcaacctggacctgacaccaacttcgccggtgctgcctggctggttgctctagcgccctgaaggagaggaatgcagtcatatttcactgtgattttcagtgtcatttccacgaagactaatgatgttgagcttttttttctccataatacaggaaagagacccaaacccatgaagaatgagatacatgtacagttttgattataaaaccaaagaataatggcttcacaagatgacggctgggctcctgggctgccttcagtgtctttaaacagagatagagtcttgctatgttgtccaggctgacactgaactcttgggctccaacgatcctcctgccccggcctcctgagtacctgggattataggcacaagtcaccatgcccagccggaataatctgaaggaaagacgggtatattcaagatgactttgctgctggaaatatgacagaataatgtggtatcttcttctgcacttccaagctctttcacactcaggctcttcctggcttttctgcctcagccaccataaactgtggttgcttctccagctctgttacagttcagacttgaggggaggtgacaagagctaacatgttaccatggggagcctggctgacatctccgaaactgaagactctatggaagcctcatgctattgcaatgtgtacatcaaaagtaaagtaccccaggttaaaactatgaggaagttgccatctttacttccaggagcaaagacactgaaactgtcccctgcaagccccttaatttcatacagtcctctgactgccccccaaccctggctacttttttttgaaataaggtctcactctgtcatccaggctggagtgcagtggcaaaatcacaataccctgcagccttgacctcatgggctcaagcagtcctcccacctcagcctcctgggtagctgggactacaggcttgcactaccacacccagcttattttttgtagagacagagtttcgtcatgttgcccaggctggtctcaggagtcactcctgagctcaagtgatccgcctgccttggcctcccacagtgctgggattacaggagtgagccaccatgtctggtcctctgacccttttagcaggaaatccagcccagcccctgaacggcatgttagacagttcaacaaagccttctagaagaccaaagaagactcataggaataagcctcttgctgattaatggaaacatgaccatttgtggagaaagtgcaatctgcattgaacacctttaggggaacctgtcatttaagacttcaagcattaccatgaaaacttcctctgaaacaccttacagacatctctgtaaaacagatttaaagagaaacacatttctgcttaatcggtacacatcaaatggcgatttaagagcaaggctaggaaaccagaagatgatatgcatatacataaagttgccactattccaaatagtaaaataaagacaaagtcaatggtcctaggagagctggtgggttgtggagccaggagagaaaggcagctcccttcaccttccctgtacattccaggaggccctagaatgacctagatggtgttacgcacaaagccctccttctcccatcccgccatcatctcaggagcaaatggccacactcgggtatacggagcagctcaagcaaccaggtcttcctgccattcccctgaaagggctggttttgccaaacgccagagccacattgtgttaatcagcgcccatccctagacacaggggcttgcagccttgtcacacaaatgagccatggagatgtttccgactcctcccctccctgccactcacaagcagccagctgccgagccctgcagactcttcctttacgacgtcggttgtatccacttcccttctggtcccacacccaagttcaggaccattttagcacgtgcctacattattgccacagccattgtcttcatctgttttgtgctgctgtacaaggaacaaacttatttggcttgtggtttgggaggttgggaaatccaagatccagggccacatctgctgaaggccttcctgctgtaccgtaacataacgggaggcatcactggtgagagagagagagcacaagaaagggccaaactcgcttttatagtgaacccactcctgcaataacaacgttcaaatgctaaccacctcttcccgtccctgcccctcaacatggccatgctggggattaagtgtccaacacatgagctttgggatacatgttccaactacagccgccacctgctgtcctccttgccttctccctcttctctacacttctgccggattctctagttggattaatcttgaaacatcacttaattgttaccactctcccaaaagcagtcaattttaacccattcccaacaggcttgagaataaaagtttcagcc

SEQ ID NO: 1091 - DNA, 2861 bp, Homo sapiens
gttgctgctgctcggcctggcccgcggcgccgcgggagcgcagggccccgacggtttagacgtctgtgccacttgccatgaacatgccacatgccagcaaagagaagggaagaagatctgtatttgcaactatggatttgtagggaacgggaggactcagtgtgttgataaaaatgagtgccagtttggagccactcttgtctgtgggaaccacacatcttgccacaacacccccgggggcttctattgcatttgcctggaaggatatcgagccacaaacaacaacaagacattcattcccaacgatggcaccttttgtacagacatagatgagtgtgaagcttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataagattcgtcactcatgctgctgcagatggcgggtgttggactgggttccctggctgttgtgatcattcttacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaagtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtaatt

SEQ ID NO: 1092 - DNA, 3266 bp, Homo sapiens
agatgccaccaccactgccaagcagctgcattcctcgccgggaaattcctccaggcaagagaacgcagagacgcccgcccgcagtccgggggaggacgcttcaccaggtgctggccacgaacaggaggctttcctgggtgtgaggggtgcgccagggtcgcccacccaggagcggcccgcgggaggactaggcgaggcccctaacggagcccccagtgtgtgtgccgaagagggctccctggggccccgcaacgcccgcagccagccccgcaagggcgcgtctgatttgccaggtgagcctccggccgaaggcgcagcgcacacggccagctccgcgcaggcagactgcacagcccgccccaagggtcacgcccaccctgctaaggtgctaactttggacatctacttgagtaagactgagggggcacaagtggacgagccggtcgtgattgctcccagagcggaagattgcggtgactgggacgacatggagaagaggtccagcggccgtaggtcggggaggcggagggggtcgcagaaatccaccgactcccccggcgcggacgccgagctccctgagagcgctgccagggacgacgcggtgttcgacgacgaggtggcgccaaacgcggccagcgataacgcctcggcggaaaagaaagtgaaatctccgcgggcagccctcgacgggggcgttgcctccgctgcgagcccagaatccaagcccagccccggtaccaaagggcagctccgaggggagtcggaccggagcaaacagccacccccggcttcgtcccccacgaagaggaagggcaggagccgtgccctcgaggccgtgcccgccccgcccgccagcggcccccgggctcccgccaaggagtccccacccaagagggtgcccgatcccagcccagtcaccaagggcactgcggccgagagcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctccctgccaagcccaaacatgtggaactaaatcttaaaacccctaagaatcttgacagtttgggaaatgagcacaatccatttagccagccagttcacaaaggcaacactgccaccaaaatctccttatttgaaaacaaacggacaaacagtagcccaagacacactgacattcgaggccaaaggaatactcctgcctctagtaaaacgtttgttgggagggcaaagctgaatttagccaaaaaagccaaagaaatggagcaacctgaaaagaaagtaatgccaaacagtccccagaatggtgtgctggttaaggaaactgctatagaaaccaaagttaccgtctcggaagaagagattctgccagcaaccagaggaatgaatggagactcttctgagaatcaagctcttggtcctcagcctaaccaagatgataaagcagatgtacaaacagatgctggctgcctttcagaaccagtggcttctgctctgattcctgtcaaggatcataagctcttagagaaggaggactcagaggctgcagacagcaaaagccttgtacttgaaaatgtaaccgatacagcacaagacatccccaccactgtggataccaaagatttacctccaacggccatgccaaagccacagcatacattttctgactcacagtcccctgctgagtcatctcctgggccttctctttcactgtctgcacccgctcctggggatgttcccaaagacacatgtgttcaatcacccataagcagtttcccatgcactgatctaaaagtgtcagaaaaccataaaggatgtgttttgcctgtgtctcgtcagaacaatgagaaaatgccacttttagaacttggaggagaaacaacccctcctttgtccacagagcgtagtccagaagctgtgggaagtgagtgtccatccagagtcctcgtccaggtcaggtccttcgtgctccccgtggagagcacccaggatgtgagctcccaggtcatcccagagagctctgaagttagagaagtgcagttgccaacttgtcacagtaatgaacctgaagtggtttccgttgcaagttgtgctcccccacaagaggaagtactgggcaatgaacactctcattgcacagcagagctcgcggcaaaatctggcccacaagtcataccgccagcatcagagaaaactctgcctattcaggctcaaagtcagggcagcagaacacccctgatggctgaatccagtcccaccaactctcccagcagcggaaatcacttagccactcctcaaaggccagatcagactgttacaaatggccaggatagccctgccagccttttgaacatttctgctggtagtgatgatagtgtatttgattcttcttctgatatggaaaaattcactgaaattataaaacagatggatagcgcagtttgtatgcccatgaaaagaaagaaggccaggatgccaaactctcctgctcctcactttgccatgcctcctattcacgaagaccatttagaaaaggtgtttgatcccaaagtgtttacctttggtttggggaagaagaaggaaagtcagccagaaatgtcaccggctttacatttgatgcagaaccttgacacaaaatccaaactgagacccaaacgtgcatctgctgaacagagcgtcctcttcaagtccctgcacaccaacactaatgggaacagtgagcctctggtgatgccggaaatcaatgacaaagagaacagggacgtcacaaatggtggcattaagagatcgagactagaaaaaagtgcacttttctcaagcttgttatcttctttaccacaagacaaaatcttttctccttctgtgacatcagtcaacactatgaccacggctttcagtacttctcagaacggttccctatctcagtcttcagtgtcacagcccacgactgagggtgccccgccctgtggtttgaacaaagaacagtcaaatcttctgcccgacaactccttaaaggtcttcaatttcaactcgtcaagtacatcacactccagtttgaaaagtccaagccacatggaaaaatacccgc

SEQ ID NO: 1093 - DNA, 4441 bp, Homo sapiens
aagccaggctgacctttatgctcccagaatcatcagccttttcattggaaaccatggaaggacggttctgggaaaataatgaaaatcataccacaccatagagacaaccagaagccctgctcagatgacagagttctcctcgccttccagaaaatgcccccgcttccgctggagaatggaaattggcaaagagagacggaaaagctccaatttgcgcctttgctattttaggagaggttgaaattacgagccaaagtggagtgatgcgctaagcggagtgacctccgtactccaagaaaagagaaaacccaggttctctgcttgtgaagtggctcgagctcttaggcgtgaggcattattatataaattcaagctcgctcgtgatccttagtaccctgagttgcctgaaggggggaatggcactgcctgcgtgtgcagtccgggagttcgagccgccgcggcaaccggagcgaggagcgcccgtccgcaccacctgtccccgccggcattccagagtagaggccgaattggcagcgagccggcccgggtcggtcgccgcctcagttcgcgcgggccctcctaggggtgtgtctcacggattccacactcggccgctcctggacaagccccgaaaggcgtcttcttccctggcgggagccgcgtgcgccccgcttttcgcgctgctgtcccggggccgccgcaggcggatgcacgtcctcaggcgacgctgggacctgggctccctctgccgggccctgctcactcggggcctggccgccctgggccactcgctgaagcacgtgctcggtgcgatcttctccaagattttcggccccatggccagcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccgggcccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagaatttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagccctttagttctttttcatgttgacagatttgtagacaattacaaaagccaaaaaaggataaaataagcattaggaaggctagccagttattcaatagcaccttgataatgtgggcaaacccttctacaaagtttttgttttgaaaagagcaaaagtaaaaagtgttctgtagtgaggttacatatcaggaacatatgagttgagcagagtaatttggtagtgtaagtcgatgcaaaaatacttctatggtacctattacaagctgaccaagataaaaagaagtatgtaacccactgtgctgtcaagcatcatgattccgggcagttttcattttactgtggattttgctatacttatgcaaggacttacactaacctcctggctgtaaatcaaacaaggtgactgaaagtggcatttatgttttcacaagggacatgcttagaagtgtgaccataaagtcacatcttgtacaatctgctcatgtgtttcatctgtagtaatatagccacaaactggacaagaagctgggtatttgggtttaaaatagattttcttgactctgagcttgtatcagtatttctagcttttgttttgtctgacagtattgcagtcttgaaaatcctgagagctaaaaaactgaaaggaatttttccacaccttgaagtcacagtgttttagagtaaaactattttgtgtacaattgtgtttttaaaatagttagtagatcactatggtatttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaattac

SEQ ID NO: 1094 - DNA, 4619 bp, Homo sapiens
aaaccgggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaaggatccatctgtctctaagtctgtagaacgaatctttaaaatctgggaagatagaaatgtatacccagaagaaatgattgtggcattgagagaagctttgagtaccactttcaaaactcagaagcagctgaaagaaaatctgaacaaacaaccgaataagcagtggaagaaatcacaaacatctgcaaatccaaaagctgctctcaagtctaagatagttgctgaatttcgatctcaggccctaattgaagagctgttgctatacaagcgctcagaagatcagatagaactgaaggaaaagcagttgtcaactatgagggtggatgtgtgcagcacagaaactctcaaatgcttaaaagataaaacaggtgggaagaagttctccaaagaatttgaagaggcaagctccaagctggaagaatttgtgaatggattagataagcaggtgaaaaacggaccctcattaacagaagcactggaaaatgctggaattttctatgaagcacaatacaaagaagtaaaagtggtggctaatgcatataagacctttgctaaccgagtaaacaatttaaagaagaagttggatcaattgaagtcaacccttccagatcctgaagaatcaccagttccttccccaagcatggacgctccctccccgactggttctgagtctccttttcagggaatgggaggtgaggaatcccagtcaccaaccatggagagtgagaaatctgccacacctgaacctgtgacagataatcgtgatgtggaagacatggaactctcagatgtggaagatgatgggtcaaaaatcattgtcgaggacaggaaggaaaaacctgcagagaagtcagctgtatccacttctgtacctacaaagccaacagaaaatatctcaaaggcctcttcatgtaccccagtgcctgtgaccatgacagcaactccacctcttccaaagcctgtgaatacttctctttccccttccccagcattggctttgccaaacctggctaatgtggatctggcaaagatcagttccatccttagcagtttaacatcagtcatgaaaaatactggggtcagtcctgcatcaagaccttctccaggaacgcccaccagccccagcaacctcaccagtggcctgaaaacacctgcacctgccacgacaacatctcacaaccctctggcaaatatcctctccaaggtggagatcaccccagagagcattctgtctgcactttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgagtaagaatgattcatttttcacccctgactccaaccacaatagcttgtctcaatctaccactgggcatctcagtttgccacagaagcagtacccagactctcctcacccagtcccacatcgttcccttttctctccgcagaacacccttgccgctcccacgggtcacccacccacgtcaggcgtggagaaagtcctggcctccaccatttccaccacgtcgacgattgaatttaagaatatgcttaaaaacgcctcacgtaagccctcagatgataagcattttggccaggctcccagcaagggcactccaagtgatggtgtcagtctctcaaacctcacccaacccagcttgaccgccactgatcagcagcaacaagaagagcactaccgcatagaaacccgcgtctcctcctcctgcttagacttgcctgatagcacagaagaaaagggggcccctatagaaaccttgggttatcacagtgcatccaataggaggatgtcaggggagccgatccagaccgtagagtccatccgagttcctgggaagggaaatagaggacatgggcgtgaggcttcaagggtgggttggtttgatctgagcacatcaggtagctcttttgacaatggcccttcaagtgcctctgagttggcatcccttgggggtgggggcagcggaggcctcactggctttaaaacagcaccatacaaggaacgggcacctcaatttcaggagagtgtcggcagctttcgttccaacagtttcaactcaacatttgagcatcatcttcccccgtcccccttggaacatgggacacccttccagagagagccagtggggccatcatctgccccacctgtccctcctaaggatcatggtggtatcttctctcgagatgcacccactcatctaccctctgtggatctttcgaaccccttcacaaaggaggcagccctggcccatgctgccccaccccctcctcctggagagcacagtggaattcctttccctaccccacctcctcctccccctcctggggaacatagcagcagtggtgggagtggtgtccccttttctactccaccccctcctccactccctgttgaccactctggagttgtacccttcccagccccaccactggcagagcacggagtggcaggggctgtggcagtatttcccaaggaccatagttccctccttcaagggaccctggctgagcattttggggtactcccaggacccagggaccacgggggccccacccaacgggacctcaacggccctggccttagccgtgtacgagagagcctcaccctaccctcccattctctggaacacctgggcccaccccatggaagaggaggtgggggaggcagcaacagcagcagtggcccccccttgggtccctcacacagagacaccatcagccggagtggtataatcttacggagtccccggccagactttcggcctagggaaccttttctcagcagagacccatttcacagtttaaagagacccaggccaccttttgctaggggccctccgttctttgcaccaaaacgcccattcttccctcccaggtactgatggaaaccaagggaaaggcattttgaacagtctagagaacattggaagtaggagtttggtttattgttgttgtttttatttgttttctctttctcgattttttttttattataacaaagggcctctcttccaaagtaagaaatcacatacgcttacgttttactattcaattcaatcctccctcccattgcacttatctaccttccccaagttgtttgtatt

SEQ ID NO: 1095 - DNA, 2952 bp, Homo sapiens
gtttcataacctcagtgtagcctcctaaaagtgtagctatcatcattttctgttctttaataagagaacactccaaagaatttctccccagctcttctatgtattattttgtcattaattttttttccagagaaaatattactgccctgttatcttgaggtcagccaagatatcccttgtcctgggctcctgttaatgagtccagagttgcactgagccttttttaattttgacagccagatctgctccatctagtatcctagtagccgactgttggaactgcaggatagcactttacaatgatctctagtatgttctctttgttactccaggcatgttgtagcctgtcagtattgtgattcatttgcccattgtatgagctcacctccccaccctgagttgtctgtatttgaggcaacttgtccatgtggaggcgacccccacggtggcccgagatcttccctaaggagtgctgccagcttgtcatcttgattgctcctactctcctggagagttagcaattttgactagcgtttggaaaattcttttatcagtgtccttagcaacaatgtgggctacctaagaggttccaggctaatcattcctttgagacaacatttagtgttgatcagctcaccaccccctggtaggacagcccaggaccccaggacgctggctttattacaatgccgacgaggcattccgtcacagcacttgaagcacttcccccaagaaacagatcattctactgagttggaattggaagtactatttcagagaaattaatagtccagtattgagcttttttttttttgagatggagtttcgctcttgttgcccatgctagagtgcaatggggtgatcttggctcatcgcaacctttgcctcccagtttcaagcgattctcctgcctcagcctccggagtagctgggattacaggcatgtgacaccacacccaactaattttgtatttttagtagagacagggtttctccatgttggccaggctggtcttgaactcccgacctcaagtgatctgctcgccttggcctcccaaagtgctgggattacaggcatgagccaccatgcctggctgtgagctttcttttttcattatcgttacgtccccctatagtcattatctttagtatttaactttgctttttagattatagaagaaatcacatgtattatttccattccaaaggaaattgttttgaaagagcacctgcagaagatacacataaacataggcagagcattttattcctaaatgttttttctaagtgtccgcgtgttgcttttctcctcttcgctttttccacgtgatttattcttgacttctggggtggcagccaggagagggatcaagaaaggttgcaagggaagatggagataattgttttgcttgtgacgagttcagtctgcatgcttttttggtaatattaaaaatatctgtgggaaagtcttgctataagtatttaaaatgtgcttcagacaaaattcttctatgttccaaggaccatccgtgatgaccatgagctgcacatacaccctgcgtcagtcctctatgcagagaagccgcctcgctgctcatgtttctttctcatttcagggtcatctataacgaagttatacagacctccaagtactacatgagagatgtgactgccattgaatcggcctggctgttggagctggctccacacttttatcaacaaggaacgcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctggcccagctctatgagaaacaaggaggaaagttagccactgaaggccaaaacaccatgtggggtggacagagggtttgctgggctggctttgctttccctgctggggccacagctgtgttaaccaatgaggtctgctgccaggtgtgaacaagcatgtctctacgaatgaacgaaacattggggatctctgccgaaaccaccaaagggcatgtctgatgggcacagggtctcccaaacccagtggcttctgtctgtcctcagcccttgtccctgtttatctgcagccaggagacttgcaagggattggtgattgacagagaggactcgtgcgctgttttgtgttagcagaggatttgtgtttcacaggtaggcttagcgtcctctcagagtgtagtgccaggtcctggtgccacgctagctgagcactcaggagagttcatcagctcagatcccacagggcctcctctttagcaggaattcacaacagtttggatgccctaaacttctgtagctcaggaacatcactggtgtatttgtttttttgcttgtttgcttgggttcttgcaagagcgcgtggggacagttcttccagcaggcactggttttgttgccccagggctgctttgctgtgatgatgattgcatttcaacacatgccagatgcagattttttcccccttactgtttcaatgacctttattttaaaaacacatagcttgaaaatttatttttatactgatattagtttggatgtgccacttttggcaccaaacgtgtatgtcatttttatttccattttataaacatgtaaataatagtgataacttgttaataatagtaaacctttatacctaaagtaaatgtcttccctcccac

SEQ ID NO: 1096 - DNA, 3083 bp, Homo sapiens
aacgagctgcgggcccgggatcgcggcggctggacggggctggagctgtcgggagggcggagctacagggcctgcaaggatgttggctgtcccggagatgggcctgcaggggctgtacatcggctccagcccggagcggtccccagtgcctagcccacccggctccccgaggacccaggaaagctgcggcattgcccccctcacaccctcgcagtctccaaaacccgaggtccgagccccccagcaggcctccttctctgtggtggtggccattgacttcggcaccacgtctagtggctatgctttcagctttgccagtgaccctgaggccatccacatgatgaggaaatgggagggcggagacccgggcgtggcccaccagaagaccccgacctgcctgctgctgactccggagggcgccttccacagctttggctacaccgcccgcgattactaccatgacctggaccccgaagaggcgcgggactggctctacttcgagaagttcaagatgaagatccacagcgccacggatctcaccttgaagacccagctagaggcagtaaatggaaagacgatgcccgccctggaggtgttcgcccatgccctgcgcttcttcagggagcacgcccttcaggagctgagggagcagagcccatcgctgccagagaaggacactgtgcgctgggtgttgacggtgcctgccatctggaaacagccagccaagcagttcatgcgggaggctgcctacctggctggactagtgtcccgagagaatgcagagcagctactcatcgccctggagcccgaggccgcctcggtatactgccgcaagctgcgcctgcaccagctcctggacctgagtggccgggccccaggtggtgggcgcctgggtgagcgccgctccatcgactccagcttccgtcaggctcgggagcagctgcgaaggtcccgccacagccgcacgttcctggtggattcaggcgtaggagagctgtgggcagagatgcaagcaggagaccgctacgtggtggccgactgcggcggaggcaccgtggacctgacggtgcaccagctggagcagccccatggcaccctcaaggagctctacaaggcatctgggggcccttatggcgcggtgggcgtggacctggccttcgagcagctgctgtgccgcatcttcggcgaggacttcatcgccaccttcaaaaggcaacggccggcagcctgggtagatctgaccatcgccttcgaggctcgcaagcgcactgctggcccacaccgtgcaggggcgctcaacatctcgctgcccttctccttcattgacttctaccgcaagcagcggggccacaacgtggagaccgctctgcgcaggagcagcgtgaacttcgtgaagtggtcctcacaggggatgctccgaatgtcttgtgaagccatgaacgagctctttcagcccaccgtcagcgggatcatccagcacatagaggccctgctggcacggccggaggtgcagggtgtgaagctgctgttcctagtgggcggcttcgccgagtcagcggtgctgcagcacgcggtgcaggcggcgctgggcgcccgcggtctgcgtgtcgtggtcccgcacgacgtgggcctcaccatcctcaaaggcgcggtgctgttcggccaggcgccgggcgtggtgcgggtccgccgctcgccgctcacctatggcgtgggcgtgctcaaccgctttgtgcctgggcgccacccgcccgaaaagctgctggttcgcgacggccgccgctggtgcaccgacgtcttcgagcgcttcgtggccgccgagcagtcggtggccctgggcgaggaggtgcggcgcagctactgcccggcgcgtcccggccagcggcgcgtactcatcaacctgtactgctgcgcggcagaggatgcgcgcttcatcaccgaccccggcgtgcgcaaatgtggcgcgctcagcctcgagcttgagcccgccgactgcggccaggacaccgccggcgcgcctcccggccgccgcgagatccgcgccgccatgcagtttggcgacaccgaaattaaggtcaccgccgtcgacgtcagcaccaatcgctccgtgcgcgcgtccatcgactttctttccaactgagggcgcgccggcgcggtgccagcgccgtctgcccggccccgccctctttcggttcaggggcctgcggagcgggttggggcgggggaaacgatagttctgcagtctgcgcctttccacgccctccagccccgggggagataaggtcatgggagagtgggtggggacacacccagagactggctttgggattgggcactggtccgctgactgccaggctgaagggacccgccaaggactgaacgggtaagagaagaggtttgcaagacagagcgcgcagcccggcaaggggcatgtgaccccgaaggaagaacgcaacagaagagtcctggtctgaacttggccgagtaggggtgggggtgggatggcaggaggagccgcaggaggaaggaggttgtgcagggtctggacctgcagggctgaagttcactcatcgaccgactcagccccaaccgggagccaggcagaaaaaccctgtgccgtaggaaagtgactggaagtggactccagagggacaggtgtggtggcacagtcctggtgtggtgctgaccacccaaatatgactgtgaattgtggaaagggcagtagatctctaatgtggaggtgggaacattattgtggtggaggcaattatgagggtagcatttctttcgagacaaaacacccgtctgggaaggccccaaggtcagcttatgaaggaccccacttgcaccccaccccagccatggaagagcagctggagggtggatggggaggccagagggagcaatgaggggtggccccagctctgctattgactcggtatgcctttaggacattctcttaccgctcatgggcctcagtttcctaaagtgtgaaatgtcaggcacttccctctaactggcatgcaacagccccacctgcctgagagccctgaggtgacaataaaacatttatgctcaagggg

SEQ ID NO: 1097 - DNA, 2652 bp, Homo sapiens
catgaagttgcaggtgatcctgagcccaagccctggctatggaggcctagttagtgttctctccactggcaggccggatacctcaggatgagtatgtgttttctgagcacccagtaagcatgaggccctgggcgcagcacgccttcaggagctggtagtctcattgggatgtaagcctcacacttcatcttcaacctcttggtgttccctgaggagagcttctgagagctgggtgctggggtgacagggtggagacgtggtccatctctacccactgggcgaaaattgctagaatcatctataacgtgctacagggactaggggagcagtgagcttagcagggcttttgggaacaagaggatcttgtatttacataaagtaactttgaaacagtcaagtagaaattaaagcctggttagtctccctccacttttcacagtgcgtccttcatacaccctctgctgcttgctcctctccagccacactgctccatctgcacaagcagtttcctcctcctggaaatgctgtcgtcctcctcctcatcttggctgcagctacaagactccatccatctcctttctgcccccactcccttgagaatctgccacttccccctccaggctcctcctgaacttcagaattattactgtaactcctagtttacccacccttttccccactgaccatctcctttcgagttcatggactatacctcattcattttcacctccctaatgcctagcttagggcatcacacatggtgggtgaaggtttgttgagtggaataaaagagagaagaatgaaggaacaaataatcataagttctcagtccaggctcatcaggtggctatgtggacattactcatcatgaagctcagaggaaggagacacatttccagctccatgtggttgagaagaggggaaatttgaaggaatgaacacttggagagggtgcagtgttgtgtctcagacagaaggagccggtgtcaaggctgttccagagatggaaggcggagcagttgtgctgatgcagtacattcatgggaaacagtgagagatgaaaggcaggctgctgcaggccatccttacctgcccttgaatgccaggaagttctttatctctgagacgctgaaggattttgagcaggggagccacagaatcagagtggctgatttaacagaactttgatttgtgcacaggaaggtgcaggtttttggtgaagcagatgtgtatttattgagcttctatacacacatgcttcttccagcagatggtaggcacagagctggtcacctaggaaagacaggaaaaactgtccttgccctcaagtcattcatgttagcaaggaaggcaagaaggcaagacaataaagcaggctgttacccagcactgttggggtggtgtggagagactttaagggaaggtttcccaaaagttaggatacctgaactgcatcttcaaagaagatcagaggtaaccaggcgaagaaggtggcaggggagaggcacatttccaagtaggtggtttgtaccaaatcatagaggtttgggaggcaaattaacaaatcataaatagttcaaggtggatagagataggaggtgcagacctcataggactctgggtgccacactgaggagtttgaatcttatcctaaagacaaggatgagccattgaagtgttttgattgagagatctggttggatttttgttttacaacgatcgcttggctgcctgcagagaataagttgaaagggataaggttggtgttttagaaccaatctgggaggccattaatccagggaggatgacaaatgtctgagcttggacagggatagagcaggggatagactggaggtgtttaggaggtagaatccttagatttggctgacccagtggaaggagaggggagggggagaagtgatggatgacttctgtctaccttatggtacatgctgttcagtgatctgggttaaagagcagatttggagaaagataaggacttcatggtggataatgaattcatttgcagtgcctgaggagtgtctaagtgaggtggtaaatggtaagttaagatgtaagtctggagctcaggagagaggcctggggtaagatggcaacataggaattaattaaaactataggaagaatgagatctcccaaggaggttttgttgactgagaagggctaaggatagaaccttttgaaaaaccacctttggaaacaccaggggtactgaggaaggaggaaatcatgaaagaaactagaaaggagtagtaagaagtggaaggaaaaccaggagagtgtggactctgcaaacagaagtgtccagaaagggatcagttgtgtctagtaccacaatcaagtcaggtcaggtaaggattgagttgtagccttcagatttagcaaaaaggaggtcgttggtgaccttgacacattcactctttagtgcccacagagagagagagagagagagagaaagagaaagaaagaaaagaaagaaagaaagaaagaaaacaaagaaaggaaagaaagaaaaaaaaagaaagaaagaaggaaagaaagaaagagggagggagggagagagggagagagggaaggaaggaaggagagagagagagagacagaaagaaagaaagaaagaaagaaagaaag

SEQ ID NO: 1098 - DNA, 1933 bp, Homo sapiens
ctttttttccatcctccctggtcaggggagcccaacagcaacgcgagggcacccgaccctctgcctgcacctggagggcgcccgggtccccccaagccacggccaggacgtcgcgtggtggggcagggaaaggggcgccgccgctgctggaaactagccctgtgcgctccgcccgcgctcccctcccggagatgtctcgagcgcctctggcgcgaacaaagcccggccgcccccgagaaacttccgtgcatgaaggtttcctccttgactcggcagcagcggccgccgcagggcacagaggcgggaacgcgcggcgggggaccagggcgtctctctccggagcgctgccgcctcctggactccgcgctccagctccaaggaccggcatcgctgccgcagccgggaggccgagaacgcgcggtggcaacgccgccccaggccacgcggcgaggcggttccgaacggactcgggattcgctcctgggcgctgtggggccgagtggagccaagcggccgtttttcagctccgcccttccgaaaggctgccgcagggtcggggccacgtggggcccgcggcagaggggctgggggaacgccacgggcggccctggtgaaggtgcccgccggtctcggcctgacccccaggccctgttctggcacgcgccccacctgcgcgcacagtgagaccggcgccctagcctgggaatccggggaatctccagcccgttgccttttccataaccccgtcttctttttcacactagctctgagggtggaaggcagggaggtgccagccacgttcccttccacagagggaactccctgttggaattcctaccccggcttcctgccgtctgtcctggaacacattgctccaggcctccgagcctcagtttcctcgtttgcaaaatgggggcgataacagagcgtcctcaaaggggataagacggaagaagttggctcatatcagggctcataattgttgccaagtattaacaggtaaccacaatcacactccacaaagcttcccttttagtgtcagtgaaattaatttaaaagaagtttccgaaagtcaagtgtgtgtgtgtgaatcctgagataagtcaggtaaggggggaaatgaccacctcacggccccaggctggtgaggaagtcctagccacggaggcggtgctgcaggacctggcctggtggcatagcgtggcgggcgggttcaccgtggagagacgaaggaggtgctgcggcttgtgagaaaaggcccacaaccccatgcagttatttatgaaatggttttccttcctccagggcttggggctcctgcccactcgtatcaggtcccgggacccccccggtggtgtcctcagggctcccgccgtcccaggccgccctccacttctggaagcagacacgaggccacgagacccactgcttttgggtatctgcttccattcctgacactgccctttaagagaaaaaagtacccacattgttcccagatggagagggtccctcccagagggtgaggcactgccacaggggctcacggccctgccaggagtggaaggtgcacacccagaagtatttctcctgtgaaggaagggggctgagcttcgctgcagacctggcctcaggtgtggatgagcttcgctgcagacctggcctcaggtgcggagtctgcgggagcagcatttccaggcagacctgacagaaggtgcctttgagaggtggtgagctccgtgttacaggaggcttgtgagcacaggtagcccatcttctggtgatgatgctggagaagcaattcaaatgtcagaagcaggactggactctgtttccaaaactcacgtctggattctaccccctgaaaacattatttacacaatgtttttcctttaaacaattcacacatttgattaaaagggtaagtttatttttt

SEQ ID NO: 1099 - DNA, 2274 bp, Homo sapiens
tgtgttcggggccgccggatcaccagcgccgggggccttcctgcggtgcttctggtgatccccaatgcgtggggtcgcctcacccgcaacgtgctcggcctttgcttgctcgccctggagcgcggctactacccggtcatcttccatcgccgcggccaccacggttgcccactggtcagcccccggctgcagcctttcggggacccgtccgacctcaaggaggcggtcacatacatccgcttccgacacccggcggcgccgctgttcgcggtgagcgaaggctcgggctcggcgctgctcctgtcctacctgggcgagtgcggctcctccagctacgtgacaggcgccgcctgcatctcgcccgtgctgcgctgccgagagtggttcgaggccggcctgccctggccctacgagcggggctttctgctccaccagaagatcgccctcagcaggtatgccacagccctggaggacactgtggacaccagcagactgttcaggagccgttcccttcgagagtttgaggaggctctcttctgccacaccaaaagcttccccatcagctgggatgcctactgggaccgcaacgacccgctccgggatgtcgatgaggcagccgtgcctgtgctgtgtatctgcagtgctgacgaccccgtgtgtggacccccagaccacactctgacaactgaactcttccacagcaacccctacttcttcctcctgctcagtcgccacggaggccactgtggcttcctgcgccaggagcccttgccagcctggagccatgaggtcatcttggagtccttccgggccttgactgagttcttccgaacggaggagaggattaaagggctgagcaggcacagagcttccttccttgggggccgtcgtcgtgggggagccttgcagaggcgggaagtctcttcctcttccaacctggaggagatctttaactggaagcgatcatacacaaggtgagagacctggcctgagaacccccaagtcctgcaaagaaaaacagagctgggcaagggggagtcctggaaagatggggcggactgaacagagggagctccagctctgtgctcctcattcagtccctctctcttaaattggtgccttgaaagagaaggaacgtcctgcgagcctgcgctcacttcatcctcagcagaactcctgcctggcctctgctcaacatatccctactcatccggtcagcagcggcgcgttccagtcactgtcacctgtcactgacatcacaagccaaaggatagcactttttcaatccatggactcaggagaaaatgccctcttactggcagtggctagagggatgagacgtttgtgtatgtcactgggcagtgaccccgattctcaagctggagccatttgatgtcatgaggacaggatgtttgtgtctcggccccacttccctcatttgctctgtggttgtggcgccctgctttgaccgaatgctctggcaactgcggcagcaggcttgtgtgtgtgagaagggcggcagaggcagtggggctggctcgctgagggctgagcaggtagagaatgtgaatgtccatctcaaggaatgcgaagttccaatctctcagaggagctctgcaagtctcagctaggaatggggctgatctggcccccaagcctcactggagagatcccaagggtattttacaaataggaagcgctctcatgcaggatctgagggctttgctagaccatggttcaaggagtcagaatcttggctaccctacatgctccctctggcaccatttcaggggattactccagagagctgcagccagaactgtttatctcctgagatatggactttctctaagtcaggaaaagcacaaacctcataacttaggtgttttctggttggttgctcccttttctgatcctactactggcctctccctttccagagccaggagacacatctgggaccagaggaaacaaaagcaccaagaggttgactagagctgaccagtgatttacaaatatttcatattccaatgcttcgtctgctcaattattcaaaaggccatccctgtaaaggcagaaaagcttcctcttagatctggccactcagcaaataagtgggtatttggttttatgaagaataatgctgaggactagagatatagtatatcagagataatatatagtatacaggttgatctaaatattctggtttggattaggcaattaaaatttttttggcaacaggacatatgtttccatgtgttgctaagattc

SEQ ID NO: 1100 - DNA, 2222 bp, Homo sapiens
gatgttcgtagccaatccgcaggcgcggtggcagctgcgggtcgcgggtcgcgggtcgcgagtcgccggtcgccggtcgcggcggagcctgggcgctgagctgcgtttgctttggttagctagaaagcaggcccatcatgcatctgtaagaaagtgactggagtgtaggccctggcgtctaagccgagtaagatgccctgtcaatctgggtcctctgggaagcaagactgatgaaatgaggagcaccaaagctttacaccccagctatgtgcatttggggctggggctgcctgggaagagctcgtcctcagcccaaagcctgcaacagctgggatcagggcttacctctcacagacggggctcagcaactttctgcgggatgaggacacaagcccacttgacctggaacgtctgaaacctcctggccccgtggaagatgggaagaaacactcctcttcctctcagttttacaaccgagtggtcctcgggctgcttgtgagcaccggacgaccgaccgagcaggctgcagcccatcagctggcacagggctccgactgaaaatcatcttggctggtgccacagaatcggcctgaaaacaggatactgcctagagcaaggcacccaggggagccaagcaggaaaatgtaatgaattgactttaagtagctgcagctgtgattagagtatttttagccacaggactcaaccagctttcaaaacctgctaataagagccccaccgtagccagcgcaaaaatttagttttcagtttaacaccaggaatctgcttagctaggagctggcttagaaggcacatcaggagagaacatcttctactgaaagttgaagatttttcattttctagctgaattatgacaaagggagatgaccattaagtgcctgccagcatactgggacgtacacctaacactctgaaaactcaattcatgccagcacatctgtcttctgctgcatctagctcagcatcatgtatgtattttgggcaaaactaatcatttcacaccctagactttaaagagacccagaatctaatgatagctaacatacccaccccctctaacaggctttggcgtatttcctgtgagaagcagttactggaggccgaatggattccactcatccacagcactgtgcatgcaacagccagattaggccccggtgggactgcgtggcccactgcttcctatgggctccagggctgcccagcagggatgacccgggagccgacaagggggaggccagtgggggcgttgggacggtttccttgaccctgtctcaacccagagaaagaagcctgcaggtgaaaaaggtcttcgtgaaaggaatgaaaaaggagagggctttaggggaaggggctgcctggtggcaaagccagcgccttgtgtccccaggcaaacatgacagagtctcgacgcacaggaagagccagtccgtctttactggagtgagtgcgggagacaaacagtttacaacaacctttagcattgtcttcaccatttgataaaaagttcactattatatttattgtataatgaagaaaaacaacacattcagggaaaaattgagattaacttatttttcttaaaaggttcatctcaaggatggcaacaaagtccagcttgtgccgccaaacggttttacatgatcaaaccgtgtacagcttcttgtgtgaactgttgactacaaacatttaccaaatacataaatctcttttaaaaaagccattttaaatatagcaaagcagtgtcttcttgcacagcaaagtgaagaaagtttctacagagaaatagaagttttacatttgtaaaatctttttcacattctaatcatctagcttaagatccaatgccaggagttttcagcttccttatttactatgtatttcttgtgcgcatgatggttaatacagaaattatgttgatgcattactagttatccttctagttaaaggaaagggtaaaacatgtattgttcttgtagaacaaacccctgatttagtctataacaaaatggacataattgggctcaaaagatggagttttgattgggaccacctgtgtacacacaacagtgacttccactcgcggtggagtggccattagagtactgaggaaggacagctgttggaaactgtactttaaccagtgcaatttaagctttttttgcttttgttctttagtaataaaatacttctggagggat

SEQ ID NO: 1101 - DNA, 2483 bp, Homo sapiens
agtttctcctttgttttacgtttgggaggaggtggcattggaaatagcagagtgcttcgcggtaacagggacaaatgtactgaggctggagcctgtgtgaacagaacagaagaggccttcactctagtagtgctcacagtccagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaaggggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttttaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattgacttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaaattgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacacctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttc

SEQ ID NO: 1102 - DNA, 3255 bp, Homo sapiens
gtgaatgacacctcgtctcccaagggtagaagaggggaccctccacaggaggtctccagaaagagctgctttgtcagtctagtctatctcccattcagagcctgtccagggctccccagtgacccggacctcatgacttgccccctacttttgtagctttatcatgctctgctcctctttccatgtccttcaccttcttgtgctggacctgtgctcttgctgttttgtcttcatttcctactccctcgcaacttactacagggcactagggccagagctctgacctcatctggccacctgcctaatgctactcagcctttgctagaagtatgtattcatgtcctatcactctgctggacagcgagttccttgagagcatgactgtgtcttactccttccatagcccctacggtgcccagcacaaggcctggcacaagtgggtactgttggtgtttgatgaacaagtgaatgaacgagcacactgattgcatctgctcaccatgcaaggactgctgtgaagagcagtcagatgtcacctcacccatctgtgtcatgttttaacagttcattaagcactcaaccccatttcactcattgacccttaaggtagcctccagtggcagcttttcctgtctcctttttccagatggaaaaaccaacattcagaaaagttaaataacttgcctgtagctacaaagccagaaggtggctgagccaggataaacttttttggctctttttctctgtagctcatgagactgagattggcatgagctggtgttcgttctcctaatttctctgatctctccctttgcaagggcccagcagtgcttttacatctcatcttcaagaatgaatcctgggcttggatagtacttataatttggctagatgagctttgtagctaccaaggattctatttgcatccttagaagttttgcctcaagaaacctgagagcccaggaaggctcttgggttggccaagctcactaggcaaatctttttttttttttttgagacggagtctcgctctgtcacccaggctggagtgcagtggcgtgatctcggctcactgcaagctctgcctcctgggttcacgccattctcctgcctcagcctcccaagtagctggtactacaggtgcccgccaccacacctggctgattttttgtatttttagtagagacagggcttcactgtgttagccaggatggtctcgctctcctgacctcgtgatccgcccacctcggcctcccaaagtgctgggattacagatgtgagccactgcgcctggccgcagatctttaacagaacctttaagagtctggacttagagaagtgttgggtgagggcagcctcttgggctggttttctcccctgtgaagtcatggctctgcagggcctggttttttggggcttgtgtggtgaccattaaatccccactgtggggggttgtttcacaagagggaaatctggtgctcctccagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgggaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatgcccgggtcaggagtgatacgcgccccctgaggcacacctggaaacccagccctctgattgtcatgcagcgcaatgcctctgttcccaacctgcgtgggtccgagaagaggcttctggccctgaagaagccagctctgccagccctaagccgcactactgagctgcaggacgagctgagccacttgcgcagccagattgcaaagatagtggcagctgatgcagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggaggaagaccctgctgtgcttatctctgaggtcctaaggaggaagtttgctctaaaggaagaagatatcagtagaaaaggaaattgacaaccctcagctctgcaaactcagtctcatgctcctggaataccttcaatagctgccttcctcaccgcagatgtttctgcctcttaaggatagatcttctgcaacagtcttgctgacaagctagagcttggactgaaagagaagagctggattatatatttcccagacttcaaaccctagcagaagctaaggcttgtgatttgacctgagacatttgtttcaggtaatcgtgtagaatgaagtatcttagtttaaagggtaagagagaagttgtttctggtttttccttgcccctgtgtgaaaataggtcctaaatgactgacttcactgcattagaccctatagctggtctcacaagacactttgtgcccagctgtcactcactctcagcagcttccttgcagcagagcagggctgaggggaaggggctatgaatgtttgtatacgtgttcacagggcacggaaaatcttatgctgctccgtcataaacctacaccaatgcccagcaatcaccctcctcacttccttgtctagatgtagaggtcaggctgctgaaccagccaacacatgggctactgctgggaagcctgggctgttttttttcttaaacacattttatattactgaacaaccaaatctaccctccacggccctgaggccttatcagttccactgattaaaaactttctcttccacggactttaagcccggtaggaaagagagaggaggagggggaaagagcaaaccatctttcttccaggcccttgactgctcctttgggctgggccaaggtttgtatgtaccacaccatgcatgactcagatgccctcaggtccctttctctatggtatgtatactgcttgtgtttgggttgaagcactacctgacattaaaggaaggacttggagagag

SEQ ID NO: 1103 - DNA, 1960 bp, Homo sapiens
atttgtatctcagctccatgatgccttgggctttctgtctcctcaacaagagcgcagcttgctgaatgtcagctgcctgagagagctggggcctgacttactagggcattaaatcctaagaggtcctactgaggtgtggcaggatcacaggccagtggaaaaagggcaggtcagatgggcaaggcccaggactttcagattaactgagaggatatcgaggccaagcatggcagggggaaggtcagtgggtgtcaagagacccaggtctgaccccggatgtttgctccatgtgacaaaagcaggcctgtctcaggaccttttcttttcttttttccttctttttttttttgacacggagttttgctcttgctgtccaggctagagtgcaatggcatgatcccagcttaccgcaacgtctacctcccaggttcaaatcattctcttgcctcagactcccgagtagctgggattacaggcacatgccaccatgcctggctaattttgtatatttagtagaaacagggtttcaccatgttggccatgctggtctcgaactcctgacctcaggtgttccacctacctcagcctcccaaagtgctggggttacaggtgtgagccatcgcgcctggccaggacctttgtttcttatctacatattggaagatttggtcctgatgtcctttgaggcttctttagctctagttctctgacacttcagcctatatcacagctaacttcctcagtctcatctattccttatgctccagcccctggcaatttgcctcaagatgggggtttgaaaataactttacctgactcaaggagtgtctggagcacctcctagtctaagtctgcaagctccagttcttgcctaaaaccatgccagtggccacccttgggctcagacagctctgggccttttgaccacaagccagcccctcgccctctctgtggcatagtcttctctgccccaggactgcagggcggcttcctccaaggcttccaaggctcaaaagaaatttggctccatccaagaaggctccagctcccctactggcccctggctcaggcccacacccctggccaggcccagagagtgtgtctcaggagaattcaatggctctagagagacacacagaaagtttggcatttggaaatttcaaggatgtatgtatgctcacgtatggagcaggttgtcctggtccctgggtgcagggaagtgggctgcagggaagtggattggaggggagcttgaggaatataaggagcgggggtggagactcaggctatggacaaggacagccccaaggttgggaagacctggccttagtcgtcctcagcctaggggcagggcagtgaagaaagctctccccgctcctgctgtaatgacccagagtagcctccccaggccggcatcttatgtgtgtcttccaccatcctcatggtggcacttttctaggcctgtctcccagcattgtgcaaggctcggaagagaaccaggaagtgaaactgggtgaaaacagaaagctcaatggatgggctaggttcccagatcattagggcagagtttgcacgtcctctggtcactggaatccacccagcccacgaatcatctccctcttgaaggattttatttctactgggttttggaacaaactcctgctgagaccccacagccagaaactgaaagcagcagctccccaaagcctggaaaatccctaagagaaggcctggggcaggaagtggagtgacaggggacaggtagagagaagggggcccaatggccagggagtgaaggaggtggcgttgctgagagcagtctgcacatgcttctgtctgagtgcaggaaggtgttccagggtcgaaattacacttctcgtacctggagacgctgtttgtgggagcactgggctcatgcctggcacacaataggtctgcaataaaccatggttaaatcctg

SEQ ID NO: 1104 - DNA, 2015 bp, Homo sapiens
ttatgactatggaattgctaaactgaattaaggaaagttgtatttcaaaaaatgtagtacatgctttgtaacaatttaaagttttatgtgaattaatattgaggctctaaacaaataactgtagttacatatcttgatgacccttgatatgattgtttcagactaattgtcaacttttgaaatattggactttgcttttatattgaggttttgattcaaataagtttgtttttttttcttttttaaatttgggactttattttctaatccttttgttaaaatgctgaaacactaggctgaatatcccagcctttttgaattttcttaattcaaaggcggtttaaccttccaccactactgctatcatccaaacccaagaattcttgatatttttatgtttacatatgcttctgctcaccggtgctaatagtgatacccaccagttggtaatagccacagtattagggaaaaaattctgatagaaacatggcagtagactggtttcaaagttgttgttagctctgcagtgggcaagcatagcttcctaactttcacagccattcagtagatttagtggatgcccttttgaaaaattacagttagctaaaaggcaattgacaccgttattctggttattggtagagctatcagcactggtttttttaaataagttgagctttttagtatcctgatggccttcagaatagctgttttgatgcctacttttagatctagttaaaataatcaggtactctgtagctttgaaaccctcttgtcttacagatgtggttaggtgttgatgtaccaaatcaaggtagtaaacaatccaagatgcagttggaggccatcctgccctgccctatgctctgtgaactgacctagctaggccttgttcctctatctgtgaatgcgtgactcatcgatatgggcgtttgtgttgggcccataccaaccttgtttagtcccacagtgttttgttcgccccacggaggccaagaaagccgcagatgaggccaagatgagatttgcccacatagatggagatcatctgacactgctgaacgtctaccatgcttttaaacaaaatcatgaatcggtccagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttacaatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaaag

SEQ ID NO: 1105 - DNA, 2454 bp, Homo sapiens
caagtcgcagccatacattatctggagggtgttagaccctggccccgcccccgcggtcagccccgcccaccgagccccgcccccgccccgaccaacccgcggggattttggcctaaacggaaaatgaaacctggtaaagactcctgggcctctcccgggtcgaggatctggcgggtcccgcagcctcggggtggatctcggagccggagactcgcgggggggacccgggacgtccgtgggggatgaggaggggtcgtgaccttcgccccaggccggggtcattcaccggcctagctctggtggtagtagcggcgcggcatgggcaggttcactcttgtcagtctgtgcgcgggcctgatgttccgtgtgctccggtcccaatactccggtccctcctgctccaaccacggcgactgcggctacgtcctcggagtcgccgcgtcgctgtcgaaccgcacgaactgcgtgtcgtccacgtagcccactgcgatgtaccggggctccccgcgacccggccgggacacggcggtgctgaactaccttatggagtgggaacctgggggcgaggaggggctgagacccgtccgaccctcctccttgagcggctccccgggtcctgcgccccagtgcgcgggcccctagctcctccccgcagaggccattcccctccggatcccgcactcacccgcccaggtctcggtcagggccagggcccccaagagcagcaggaggagggttcgggacgccatgaccccatcctcggcgtctggggagaatctgagtcccaatgggttcgcggggacttctggaacagggaccccagcgacgccgattggcttcgctagaaacccgacaccaaatgggggtgagaactgagtccacatcctgagtgtccaggaagaaggaccctacataagttgggagagggagaagagaaactgcggagatggggaatccccaaccctgggcctccccaatcaatacatcgccttcggggcctgaaaccctgagagccacgcctggggccataggacttcgccctgaccccgctcctcctgtgccaagcgctctgtctcaatgtctccctgagtcttggcccaagagctatctgagaaaccagggagaaaccctcgtcatgggccccgtccctcttcatttttcatcccggaatccccgtcccagaactggactccctgcctcccactccttacctatttccctgaactcttctagaaaaaaactcaccccagggagcttggtgacagagagggagctcgccgccagagagggagctcgccctgggaatggaggcgtagagacaggtttttgttttttttttctttaaatccggaaaagttgtgcctgagtacatgagacagcatagagacaagttttctctttgtttgttaactacagtgggtagcagaatcttggcaacccctaaatgatcaggtatgtaatcggtaaaaaatgtaactttggccccttgatatataaatgtgtctgaaagcattacaacaggactcacaaagctactaagtttgactttcgcagacaatgtatctgtgactcccgcttgtcttttacatttaccttcattccacagccctgagttactgggtgagtccaagacatctcctcaatataaagtagcacactgcgttactatatgttgcaaccgggagccagtacagactttattcacctcacagttgcaagtgttcaatgcagtcacaatgcccctcagcagtgctcatgtgctgcctgtttttaggaagtattcacatctaagtggtgtgtatatcttataggaacacttagtatttttaaaacctgattaattaaaaaaaattagtttctaggcagtcccaaatatagtattaaaggccaactgcaaagaaggaacactaagtattttttaaaccttattaacataaaaaacattagtttttaggcagtcctacattaggtattaaaggccaactgcaaagaacactgagcgaggctctgtagatggatgtaataaaaatctataaaacaatgtgtttaaacctaagaattctactgctttccaattccttccctctgctccttttcctcacctcctgcttctccagcccttccctctgtccctttcatccctcaggccctcctctccccttagtccccaccaccctgtcacttctaaattgtggctctagcattgtcccattacctgctacgtgactgttctctccacagtggtcctgctcctgtgagtcagagtgtgtcatttcctcacctaaaacactccagtggctccacctcggtcttgtgaagcttctagaatgtcaggcacgtgagcatatgagggcatacctggttcatcttaggcactaaatttttgttgactgaatgaatgaaatatgaatgtattaaattgcatcacagaaagttataaaatgtaaaacactg

SEQ ID NO: 1106 - DNA, 2601 bp, Homo sapiens
acatgctttgcccagctcagcctacatgccctctccggatgtcagttaccaggctttgctaataaaacgtctctcccggctcttccagagagccagccgcagagtctctgccgtctccccgtgcgctcaagcacaagcccccaactaaaagccttgtctggaaaatctgcttggtgccataacagattatctggtgagccaggtaggagcacaaggagtaatttccctccctgcaggggaggcttgtgagcctgcgagccggagggaggccccactgattcagcgctgccaccgcgactggcgagttttcctctagtctcgcgactggacactggtcagtagaacctggacctgctgtaaggctgaagaagaaaaagaaaccatccaagctggcactcggttttggggagttctcttcactgctcacgccggccctcttgtgtgacctgtactgttgtgctgtgtggggctgggagccaactctcttttcgtcgcctgacacctgtgcttgcaccctgcccctggtcctttaataagacaagcagacacaggggctacagtcatgggcaatgccccaggcatcttccaagactcacacctgggatgtatcatttctaaatggaaggaatccaaatcagatggtttaaagaaaaagaaactccagcctgggaaacataggaagactccacctctacaaaaaacaggaaaaatgagccgggtgtgggggtgccttcctggggtcccagctactcagaaggctaaagtgaggatcgcttaagtccaggaggttgaggctgcggtgagttgtggtaataccatagcactccaacctgggcaatggagtgagaccctgcctcaaaatcaaattttttttttaattaaaaaaaaagaaactgattttcctctgtaatacaacctgccctagtacacattagatcaagaaaaatggccatgggcagaagtggatctcctagttttaacactatcttaccgcccgacctattctgtgaatggacagagaaatggggagagatacctagctacaagcttttatgaagttatgctaggacccagagctactggattcttgtcaggtgtgtgtggcccctatttccaggttcctcctgaaggaacctgaagaagcggacctccacagcctcagaccccgagcactccctccctaccctaagcaggcctcctggggaggggagcccctgtgctgtccccaacagcgctccaatcggactccaaacaggcaccctcttttgcttccccactggcccagggctgttttcccctcagagaaatggatggaaacgggggagtgacaaggatccaagttcctttttttggtggtggatctaggactatgtaaaaaacactttggtagattttcagaggatcctggtaagtttagagatgaatttgttaaactaaatcttgccttttcattgacgtggcaggatgttatggtcactttgcagtactgatgaaaagcaacacatatttggaaaggctaaggaatatgccaatagccaggtggtcactaaagaccaatatgcagtcatctgtttagggggagatgcggtcccaggcatagtctccacgtgagtgagactatggagaaaacctagaaaaagctagaatgagccactttgtcacctgcctgactgaaggaagaaggaaatgtatagtaaaacctgtacactatgacagggtcaagaaaattacccagagaaagaaggagatcccagtagtcttcctcaatcgagtccctgaggcccttgggaaatgcacccatgcagacccagaggcagcagaggggaagcatcgcgtgccatgcattttatccttcagtcagctccggacattagaaggagattacagaaaatttggaggccagaccccagaccctgctgttggctttggcagaggcggcttttaaggttttcaataacggacaggacacagatggcaggtaagaagaggagactgaccaagacagcacagcttctggctgccctaattcatccaccatctcagggtgaccctaggattctcaggagaccaactaatcgaagacagccaaccttggatggagccaatgtgcctactgcaggatggagggggtcactggaagagaggctgccctgacctccttaaaacaggacagccggcaggcaaccctggccagccgccactcctcaccaagctttcagatgagattgatacacaccgcctgacagcaccctggctctgactgcagcacactccatcgtcatcacaccacggagcctcaggtcacccttgatgtggcagttctaggaactggccttaggaaatctaactatgaaaccaaggttatggagtatcccacctcaggaaggaacactgaacaactgattgacagtcttcttgccgccagccagaccaccaagtggcccattaaccaagagaaccagcgcaaccagatacgctgacccgcatctcctacctctcatgtgctttgcccagcccagcctgcataccttactcatgatgtcaattcccaagtttcgctaataaaaacatctctgcaagcctcttcagggagccaacaag

SEQ ID NO: 1107 - DNA, 1696 bp, Homo sapiens
ggaaaacaaccagctgtcacagggactaactgagggagaactcactcatcacctgggagatggtgctaggccattcatgaggggtccagccccatgatctaatcacctcccaccaggcccacctccaacactgggaatcacatctcaacatgaaatttggagagacacacatccaaactattgcaccacaggaagctggaagaggtggacggtcctcccctggagcactcagagacagccaccaacaccttgatctcagattcctgactcccagaactctgaaaaaatttttgttgttttaagccacatttgtgatattttgttacggcagccacagcacggatatagctggtaacagagttctttagcctccaaaatacaagcctggggtaaataactattgaatttggccacatggaaatcaggaagaatgtaataagcatcatcgatggacgggatgacctgggagatcgtggcaagtttaaagctaattggaagttggcaaccaaaaaatcctgtcttgcaaattgccaggaaattgccaagaaaacttttagaaaacatggttaaagatggagaaacctggatgaatccctggtttctgaagaggtgcttaggcattgaagtgagactgatgagacttcacactgtaccttcagaagggcagacactcacgagatcatcaaccgcggctccctcgctgggaggcagacacagagctggaggcggcggccacaaactaggtgggcagagaggcgtcagcatcgggacttgcgggaggccctgggaaggaacaggcagcggtggggcctggacagccctggggaaaggaagttacttggaggagaccaggggcttgcatttgggccaaaaccaaggacaagagatcagctggtcccagggaactctggagcccagcaccccaccacgggtgcagggtcctgacaacccgagagggctgtgggcaccgggcaccagcctgtggggattctgaaggctgctgcccagccacacgtcccggttctgaacaaagggttcaagagacacctgcaaacctacctttctgagagcagcctcttagcctcagctggtattggcctttggtcaccccacatgccccgacagtggggcctggcctcagaaaggggcccctccatttgtactttctatctgatccttgacacagtgctaacaccaaagaccaaacccgaatcttggttcacatactctgcaaagaaatgactaagactagttcttccggaggtcagttttagaacgtttattctgacttaattctgccttatctctgtgcaccaagaaaactatctgcacatctgtagtaaaatgtgaaggtaccttcattttgtttgtatactaaacttttaagaaatacctcactttttaaaacttggttttgtgttttgtatgcttataatattttccataatagatcattttaatgatgaactctgagtcttctgacagaatgcagatcaatggattcctagccatcggggaggcgttgattgcaaaggggcctggtggaatttttggagagattctacatcttcttgcaactgttcatctggattacggtggtggttgcatgactgtgcatttgttgaaacttacatgtcacaggatggattatactgaatgtaaactacacttgagtaaatatgacttttaaaacttt

SEQ ID NO: 1108 - DNA, 2037 bp, Homo sapiens
aaaacagttgagaacagactccaccttgtaggacagtggcatttctgaaagttcagaacaattccccgagcaactttacctcacaatctcattggaacggctgcatctgtggggccctgggagagactcagcagcagacagggtctccagagcacacgacaagaggaagaatgcatgaaggtccaccggcagtcgaatcagccaaagcacaagacaaacacaaagtcttgctctgtcgcccaggctggagtgcagtggtgcgaccttggctcactggtttggggcatgttcctgggtgtgtctgtgaggagcaagaaagccagttcaagtcccaaaacctcaaaagtagggaagccgacagggcagccttaagtctgtggctgaaggcctgagagaccctggcaaatcactgatataagtccaaaagctgaagaacttggaatctgatgttggaatctgatcttggcccatccttgaagaatctgggggtaataaataccctgaacattgatgaacccaaagggaagccagaaggtcagatgtcagctgtcgggaagaaaggctggataggaaataggaaaaagcagggcaaacaaggagcttcaaggactgaaacccttaagaaccacttgactctgtctctcaccacctccagccttgatgacacggtgacatatagaagaactgatgccctttgctttgagctgcacaaaaacctggcgctggacttggagaagctgaaagacaggacccggcaggagcctgaggagctgcaggctgctagcctgtagaccaccgtgctgtgttagccactgcagctgggaccattctgacactcagagcctggaaatggctgctccctcctgcctgctatccaagtatcctgtggatacttggcttttctcttgtgggcaacactaacctgaaactctttggggaagggaattgaggaaatgtagttccaagattagccaatttaactcagcataaacccatcacagggtttgactacagagttataacgttattctgtaggcaatgaaaacagaagtttttgaaaaaggcatcaatttgatgaaattgatattttggggaagattaatcttctgctgagtaaaatataacaggttggaggaagatgaaaatggagagagtagagtgtaattaaaagtttgttggaggccgggcacgggattacggctcactcctgtaatcccagcactttgggaggctgaggtgggcggatcacctgaggtcaggagcttgagatcatcccggccaacatagtgaaaccctgtctctaatagaaatacgaaaaattagctgggcatggtggcgcacacctgtaatctcagctactcgggaggctgaggcaggagaatcccttgaacccaggaggcagaggttgcaatgagccaagatggtgtgattgcactccagcccaggggacaatgtgagactctgtctcaaaaaaaaaaaaaaatttgttgtagtagtccaggtgtccgggtgttgttaccagggcacccatgatgaaataactgggagagtccttttttctgactggttttcttcagtccctttatctacaggcacaactgctgaagaaaccagatggcctgggatggcaccagagcttttttacccttgaccagatactagagggaattaagaccccacaagtgggcacgaactggaactggcgacccctagttgccttcagatcattaacacatcattataatgctaaaattccctgccattttgtgaacatgggttgcatgaagacgtaagtttatgaattgcctctgcacacctagagtcccaccctgtacaggctaacattcctccctacatgcacccccccacaaacacaccctgcctcccccagtccttagaaaccctatgcctggccgggcgcagtggctcacgcctgtaatcccagcactttgggaggctgaggcgggcggatcactaggtcaggagatcgagaccatcctggctaacacggtgaaaccctgtctttactaaaaatcc

SEQ ID NO: 1109 - DNA, 1936 bp, Homo sapiens
atttcctttttttcctctttgcccaataaattcaatttttctcacccttcaaagtgcctgtgagcctaatctctcctggctatgtgacaaggaccccgtttttagctgaactaaggagaaagtcctacaacataactagatgaggttacggcaggcactaaatctgccccgagtgcttgactcagcctcacttgatccgctgcaacagcctcccctctggactgagatggtgagcatcagccaaggcaggactcggcacacggtgcagtcagcagcctctccagggtcatgccaaggtttccaggaggccagtctttgctggaaatttctcagtgaccacttttccccctttctttctttcttttctttctttcttttttttttttttttttttgaggtggagtctcactctgttgcccaggctggaatgcagtggcgtgatctcggctcactgcaacctccacctccctggttcgagcaattcccctgcctcagcctccggagtagctgggattacaggcgcacgccaccacgcacagctaatttttttttttttttttttgtatttttagtagagacagggttttgccacgttggccagactggtctcaaactcctgacctcaggctaactgcctgcctcggcctcccaaagtgctggccttccccctttctttacctgcgttcctgttggatggatacatggctattttcttactgttagagacacattctctctctctctctctctctctctctctctctctctgtccatctctcctctccctttgtctctctcattaaagcaaataacatagcaggaggaatgggaaaagtagcaaatcccaggctagtctcatcatttctgggctgaaatggaaccacttgtggtgtgtggaatcgtggcatccggcatgccacattccctgctccctgttgtcctgccctgtctgtctgctacaatcacctggagcccctccctcaaccaagacatcaacaacagaaacaaaactgcttcctctgaccagcaggaaatttccaggtgaacacactctggcttaagtaattaggcaaagaatgtggctttgtgcagttgtggagagactcaacttgctcttagagtctttgtttctgttcagtccctggagtgcccctgctttcactgctgtcctttgccactagaccgggcagaaatccgcctttttcctgcattccttccactgttgttgattcagctcattttacataccaaggcacctttcctgattccattctttggccaaagactccctcagaactttaagaactttaagccaccaaatgcagcaggcacttttttttttttttgagatggagtctcgctctgttgtcctggctcactgcaacctccacctcctgggttcaagtaattcttctgcctcagcctcccaagtagctggggctataggcgagcgccaccacacccggctaatttttgtatttttagtagagatagggtttcaccatattggccaggctggtctcgaactcctgacctcgtgatccgcctgccttggcctcccaaagtgctgggattacaggcgtgagccacggcgcctggccagcaggcacctcttatgcttgctttgaaaatatacttatgaggttagtgcccatcttcctgtcttatgattcgaatcctttccttctttcttccctaattcctgttctttttctctcatgacccctggctacccattagcctttggaaaaattctattatgtttgcctgtttgtttttttctttttaatgtatatgttaccagaaaggggtcccaatccagaccccaagagaaggatcttggatctcacacaacaaagaatttcaggcgaatccacagagtaaagtgaaagcaagtttgtaagaaagtaaaagaataaaagaatggctactccat

SEQ ID NO: 1110 - DNA, 1096 bp, Homo sapiens
cgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagcggtacccaaacaggcaaacaacagctggatctgaacgcatgctatcacaaaacgtatcacagagatttggggctggcttcattggaagaggcagatattcctatcattccggatctggaggaagtacaggaagaagactttgttttgcaggtggcagcccctcccaggtaggttaaatcagatatgattggggaggcaaagaacacgtgaattaatacactccagatatcatctatagtggatgtcaatctggatctttctggtgttgggctccatccagggttcccattttgttattcccattctggtcatcccctgctgtatacaaggttctggggacggtggcccggcagcactcctggaacaggtcctgcctggggttcccgcctctcgctctctctttccttcagcatccagataaagcgggtgatgacctaccgtgacctggacaatgacctcatgaagtactcagccattcagacactggatggggagatcgacctgaaactcctcaccaaagtgctcgcgccggagcacgaagtccgggaggatgatgtcggctgggactgggaccatctgttcactgaggtgtcctcagaggtcctcactgagtgggacccactgcagacggagaaggaggaccctgcggggcaggccaggcacacctgagcccgtcacccatgctctagacatgaagaaatgcaatgagcttaaagctaaagaagcttgtaagcagctccgaatttttacctggaatattttgtaataaaaatatttatattcagtcaaccac

SEQ ID NO: 1111 - DNA, 2760 bp, Homo sapiens
gtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccgtctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggtcagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctatcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgacaacctggtcttcatcgtgggcaaactggacgggctgatggtcactggagttcgcagacacaatgcagatgacgttgtggccaccgcactggccgtggagcccatgaagtttgtctacagaggcaggtgatgcgctgcggacccccacgccgggagtagattccttcatttgcagctcgggaagtctttgtgcagtagatggaaagcccagcaaacttgaattcacaaagcctaaaaattgttgtacatcagaaaactcctaaagtaaaaggaaaatatttgcagcaat

SEQ ID NO: 1112 - DNA, 1989 bp, Homo sapiens
cattcttgtaacccaggctggagtgcggtggcgtgatctccgctcactgcaacctctgcctactgggttcaagcgattctcctgcctgattctcccaagtagctgggattacaggtgctcactaccatgttggctaattttttgtatttttagtagagatggggctttaccatgttggtcaggctggtcttgaactcctgacctcaagtgatccgcccacctcggcctcccaaaatgctgagattacaggtgtgagccaccgtgcccagtctaaggcacacaatttgcaaaggaaattgaggctctcgcacaaatccagtccaccctgtacttacacccaacatgcaggaggtgttgactctcatcccttgactcaggacatgtgtgtaattgttaatgtcatcgcaaggccttttgacaagtgtaattgtgacatataccttggcctagcatctgagttatttgttgtttcctgggtccagctcacagtgccatatcactggatccagacccttggtaatgtgattctattctgccttgatacagcccacaggggtcattgtgacatcgctgggcattgcacctaggtgatttgagtctcctcttctgccttggtgctgcccacaggtgtattgtgacatattgctgggcgtatgttatgtgactcttgcttgtgccctaaacacataggccattgtaacattgctgagtgcaacacccaggtgatgtaacgcttcaccctggacctgtctacagagggcattgtaatatatgtcttcaccaatcacccaggaaatgtgactttttattcctccctgttctgtactcacagggggtattgggacatattgggcccagcacctagctgatgtgacttttctctattctaggttctgacaacaaaggagattgtgacatattgctgggcctaacactaaggtgatgttagttatttgctttggctgtgcccttggaaggcattgagacatactgctgtgcccagcaccaagatgatgtaacgtgactcttctgcttcaggcctgccaaaagaaaagattgtgacagatcactggacccagcacctaggtgatatgactctcctcatttgcctgagacctgcatattttagacattgtgatatacaactggaacaaacacctaggggttggaaggctcctgcctgagtccctcccacaggaggccttgtgatgtttttttgtttgttttttgttttctttgagatggagttttgttattgttgcccagactggcatgcggtggcgcaaccttggctcaccgcaacctccgcctcccgggttcaagcagttctcctgcctcaacctcccgagtagctgggattacaggcatctgccaccatgcccggctaattttctatttttaatagagacggggtttctccatgttggtcaggctggtctcaaactcctgaaatcaggtgatccacctgcctcggcctcccaaaatgctgggattacagttgtgagccactgcacccagctttgtgatgtatttctgcatccatcatgcaggagataaaactctgtatttttgcctgtattctgcccacagggaagattttgacatattgttgggcccagcaaccagtcgttttgtctgtcatatctgggcccagcacccaagggatctcactcttctacctgtgccctgctttcaggagggattgtaacatccctggtcaagcccccagtgatgtgattctcctgtttgatgcctgccctcagggaggattgtgacatagccctggcccaacacacagttcatgtaactcttgaatttgctctttacatacaggtaggattgtgacatatatctggccaagcgtacagatgtaatgatgactgtcataccttgaagaagccaatagcagagagaatgttgctctcaggcttaggaaaatgaggaagtctttctgtacaaaagtcataaagaattactactctctcacat

SEQ ID NO: 1113 - DNA, 2852 bp, Homo sapiens
cttgctgggatgaccccgggggcgagtgcccggccagtgtgctcccgaagcgggctgcggttccgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtggcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggcttccacaaggtcatggagggcatccacaaggccatcgagctgggctacaaccctgtgaaggtgaactgtgtggtgatgcgaggccttaacgaggatgaactcctggactttgtggccttgactgagggcctccccctggatgtgcgcttcatagagtatatgccctttgatggcaacaagtggaacttcaagaagatggtcagctataaggagatgctagacactgtccggcagcagtggccagagctggagaaggtgccagaggaggaatccagcacagccaaggcctttaaaatccctggcttccaaggccagatcagcttcatcacatccatgtctgagcatttctgtgggacctgcaaccgcctgcgaatcacagctgatgggaacctcaaggtctgcctctttggaaactctgaggtatccctgcgggatcacctgcgagctggggcctctgagcaggagctgctgagaatcattggggctgctgtgggcaggaagaagcggcagcatgcagagttatttttgatgttccccaattccccaccagccaatccaagcattttctcctgggacccgctccatgttcagggtctaagacccagaatgagtttctccagccaggtgggcactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactgagctgctgcagtttcacagggaaggctgcacctatcaatcaatcaatcaatcctatcccaagacacagttccctgagggaagaagaggagggacctggaaaggcctaaggatgtactctctgtatagccccgctatgggaaaataaagtggagtagggggcatag

SEQ ID NO: 1114 - DNA, 1670 bp, Homo sapiens
ttcttccaggtcattgagcagctcaactcgcagaaacagtggaagcagtcgaaggacttcaacccactgacactgtacttcagagagaaggggatggagaaagagtaccgactctctgcaatccccgccttcaaatactatgaagcctgcaccttcctggtttttctctccaacttcatcatccagatgctagtgacaaacaggcccccagctctggccatcacgtatagcatcaccttcctcctcttcctcctcatcctttttgtctgcttctcagaggacctgatgaggtgtgtcctgaaaggccccaagatgctgcactggctgcctgcactgtctggcctggtggccacacgaccaggactgagaatagccttgggcaccgccaccatcctccttgtctttgccatggccattaccagcctgttcttcttcccaacatcatcagactgccctttccaagctcccaatgtgtcctccatgatttccaacctctcctgggagctccctgggtctctgcctctcatcagtgtcccatactccatgcactgctgcacgctgggcttcctctcctgctccctctttctgcacatgagcttcgagctgaagctgctgctgctcctgctgtggctggcggcatcctgctccctcttcctgcactcccatgcctggctgtcggaatgcctcatcgtccgcctctatctgggccccttggactccaggcccggagtgctgaaggagcccaaactgatgggtgctatctccttcttcatcttcttcttcaccctccttgtcctggctcgccagaatgagtactactgccgcctggacttcctgtggaagaagaagctgaggcaggagagggaggagacagagacgatggagaacctgactcggctgctcttggagaacgtgctccctgcacacgtggccccccagttcattggccagaaccggcgcaacgaggatctctaccaccagtcctatgaatgcgtttgtgtcctcttcgcctcagtcccagacttcaaggagttctactctgaatccaacatcaatcatgagggcctagagtgtctgaggctgctcaatgagataattgctgattttgatgagctgctctccaagcccaagttcagtggggtggagaagatcaagaccatcggcagcacctacatggcagccacaggcttaaatgccacctctggacaggatgcacaacaggatgctgaacggagctgcagccaccttggcactatggtggaatttgccgtggccctggggtctaagctggacgtcatcaacaagcattcattcaacaacttccgcctgcgagtggggctgaaccatggacccgtagtagctggagttattggggcccagaagccgcaatatgacatttggggcaacacagtgaacgtggccagccgcatggagagtacaggagtccttggcaaaatccaagtgactgaggagacagcatgggccctacagtccctgggctacacctgctacagccggggtgtcatcaaggtgaaaggcaaagggcagctctgcacctacttcctgaacacagacttgacacgaactggacctccttcagctaccctaggctgagattgcactcgccttctaagaacctcaataaagagactctggggtgtctggaaccc

SEQ ID NO: 1115 - DNA, 1611 bp, Homo sapiens
aaaacttgcttgttcacgagaatcacgtggggagcgtgttaaaattacagattccttggctccacccgcaggcctactgaatcagaatctcgaagggaggtactccggaacctgtatctctaactagggccccagaggctgcttatgatcaggtcctgcgcttcccgaaaaggatgaagctccagctgcagttctggggaggcctggaccccagctccgggggggccgggctaccaaggccgctgggcctggagaggcgcgtccctggcccatcttatcagcgctctgcagggtctgggcctgctgctcgcgtcctcctgggctcccaaggccacgggtgggttaatggcttgacagccggcctcctggcccagcagacgctgagcagcccgatggcacaatccacctcttctctccaaggccagctggagggacgaggcacgacaaggccatccctacagctggcacttcccctacagctgagagggggcctaaactacaggacacactcccaagacccttaagccctggcagcatcccgggggaggggggcagcaggtggaagtggaaagaagcctgtggagctgccagcagggagagggagtcggacatgaggctgagaggcctctgggaacccctgtgccaaggggctgctggcactgggcagcagcaccccagagcccacgaggagtgtgcccagagcaagtggctcagacctgggtcatggctcgagggtgtcgggctgtagctgctggtcccagagagtgcagcccagggcaggcatcaggacaggagtaggaggagaaagagtgttctaggaagagtctagtcccctaatcctggtggtggctggcagtagcctagtgcacgctgtctggcttgtgtggctgtgctgcctgagtatacataccctagcaacattctccttgctcagcactggacatcagctctccacctggccccttcctctagggaggggatggggaggcctcctagggttagcagcaggagttgggcctcaggaatcaggagcccttgaaaggaggatgcgtggttcccataaaactgagggttgccctgggccctacccttcctgagtcagctcttgcttcaattccttgaagcaccccagcatcctttcaataaatgcctgccctttgtggcctgcaaccagaggaactgcaactagcacactcactgaaggaatcctgctgctgctgctgctgctaaaaacaaccgaggtcatggatgagggggtggaggatactctcatcccacctccagactgacaacaaaaagacctaaagatctctgtgtacctgggactgtctaccattgaagattagccatggtaacttgttgacttagtgatcaacttcctgcagaagcccataggtccacctggactctgcccaggccagcgtgttctgaaaatggagggctctgtcaccattcactcaacaaatgtttattctgcactgaccgagggccagatgtaccaagagctgtggacacagcactccaacttactccagggctactgaaatcagggatggcttccccaaaaggcacactaaggaaagtctatgtcactagcagagaagaggcacc

SEQ ID NO: 1116 - DNA, 2068 bp, Homo sapiens
cttgcgcaagagcagcctccgtttcctgggacaggcctccccacccctgcagggcctcagccaggacatagcaaatcccagcgcctccctctggggctcctcagttcccagtcaccaaggacctctggagcctgctgagctgacacacacaggaaagggctccaggctcgctctgtctcccccacctgtcctggcctttctgagcgcccccatctctgtcttctgccgaccagctgaccctgagcaagtcacttcctaccttcatttccctgcctgtaagacagcagtccctgcctgtggggttaatgatgacagtccacggccccgctgggatggagccctgctgggtgcccgcaccgtgctcagtgtggcatgcggcccgggtgtggagggagacggtggagcatcccgtgcctagcgtggtgccagccaagggcgggtggctggggagctgtgctgggagctgtcgtaaacccgtggtggctttgatcctagggccgtctttctgctccacttcccgggcactgttccgagggaggctcaggtggggaagcgagtgagcctaaagcccaggcttgtctccttggtgccaggccctgcttgctggaatctggtgatcttaggaggtcactgttgcaagggaggggacccaggagccacctagtcgaacctctttgtggtacagatggagaaaccaaggcccaaacagtggcccccttgatcagccagaagcagagctgggtggggcagcaggggatccccaccaccaggctcagactccttcaggatgcttttgcttcgcagatgaggagaccgaggcttagagaagagtagagacttgctacccgttgaggtggtaacagccaggctagaatctcctgaaacggggcagggtggggaggtctggttgggctacctggggccgggcgcctttcccccaggatggggtgtactgcccgccctcccccagtcatggtgctggtgccagctggtgcagggggagggctctgcaggccttaggcactgaggcaagtggcgagcagcaggggaagggtcttctccacccaccccaactgcccaaggttccgtggctcctccttagacagcagtgagggttgggggtgacaggcaagccactgagcctcagcaccgcgactcacccctcccactcagcagtccagccagggtcatccccagcctcagaggagcctgggaacaagggcagcggcagggccggcgggggcctggaggatgagcaggggcctttcttcctgcagacagccctcagcgcctttttccaggagaccaacatcccctacagccaccatcaccaccagatggtaagtgtccccggagtccccagttctggattgggcggaaggaggccgagctagttctgtgtataagcagcccctggccccggtgtacgagggcgctggtgcaggcggggctcgacctctttggagatgggtcagcaggagtcccggctccatgggtcctgcacttaatcttgcctgtgccagctccccctgagacctggggggcgctggcctctggggcaatgaagctccttaccctacagcccccggggatgctgtggctgatggaaaggggtgggctgggaaagcctcgtggccccaggcaccctggcggagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaacc

SEQ ID NO: 1117 - DNA, 2832 bp, Homo sapiens
gtctttgcgctcggaccttcgccagaggggccgggacatcatgacggtgggagccaggctccggagcgcggcggacgagcggggcccggggacccggggcgcgcgagggcgaaccgagggggacgaggaggcggccgccatcctggagcacctggagtacgcggacgaggcggaggcggcggccgagagcgggacgagcgcggcggacgagcgctacgagccactggaggagccggcgccgagcgagcagcccaggaagaggtaccggaggaagctgaagaagtacggcaagaatgtcgggaaggtcatcatcaaaggatgccgctacgtggtcatcggcctgcaaggcttcgctgcagcctactccgccccgtttgcggtagccaccagcgtggtatccttcgtgcgctaatgggagctgctgtggcaggtgcccccagagtgaacgggagcccctgctgtgggaactttgtgaatcctggagcatctcagacttgaacacacagcatatttggaagagaaaacatgcctttctttgttgaatcacattagtatgatgagtgagtcatccctgcccatctgctgagcttctcacatctctcagtcacacgtggacccagtggtcaatcctgcagagaattcggcggaggttaggtttgggagtggagctagcgtgctaaagccagagccttcacgtgaaggtggcaggcactggggcggaagccaacactcaacagatgcaagcagtgtgggtgtgcagcagaacagtgatcttgggggaggaagaggatgttactagagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagataaaaccttgtcattttaccccatccctgcatgactgtgaagctggcgaggaaggaggaagaagggcaagttcagatgcaggctgggtggctgggacaggttggctaagggactactctggagggctcttctgcctggcattgcccacttcggcccagccacgtgtttgcagcgaccagagtccctgcaaaggtgtggctggctgtggtcagggtgctactagcaccatcagcgcactcccgccattggctcagctcctctctgccagtccaactaagagtgctttgtcctgggtgggacataggggctgagagagatggggggagacataacacccaggaatgaaaatacagatttagagaaggaaccagtaagtaggagacagatgtgaaggaaatggaaatgaggcaagaggacattggaagagagaagtttgctgtccaggagccaggtctggagcatcagcgtgagggagttcaggtaggctgggcctgtgcctctaggtagggacaagggaggctgggtagccagggctggtgcttaaaacccctgaggccatgagctcattggctgcctttgtagcatcctgtcttcttctgtgctgcctggtttgatctcatctcacctggattcaaagggtaaggtgggcatgggtcttgggcctgacacccaccaaggatgacctgtggactgccatcggatgctgaacagggagatgaaaggaggtcctcttaccatacccctctgccaaccccccagtaggccactgttctgactttgtttccagaatatccagaaatccaaaggggctgttgctgaacagtctgcaggaccagtgacagcacctacctgttgtcccaaggcatacaaaggaggcctcaacgctcatgcttctctaatcaagccctaccaagacagacagaaagacagacagaaaaaaggaaggggtagaggagaaggttgaagctgtggagctagactctgcttcacttcctgaagcttcaacttcatgtcgaagattcactgggacccaattcctgcattgttaatatttgtgaggaaaagtgaaacaagtgatctggttttagcccagatgatgaaagtggatatggcacattttcacacacgtgagataattacagcttgccccacaacactgggtgttggagaaagggagagatagtcataagtggaagaaaaagccaagcatagtgagtgggaaagagagtgagagcctgtgcaggctgctgacgagccccaggcagcccacaagtttctcgtggggagatggaggcagagcccagggtaggggacagagctgctggggcctttccttgcctgggaatctgtcccaggaagagcttccccactcccatcccccaaattggaaaaaccgtacattcaagcctgtttggccctgaaattcttaagaatctggttaagaattaactcactaatgtcaaaagtcaaaacctcctaggggttgtcctgggagtcaggttcacgggtacagaagatgaatctcagatgtcactcaacctgagccgtcattctctgtggcagggctgccctgggtttctcttactcaatccctggagtgtaagcatttggattgtgtcacagattacctttttaccttttctttctttttttttctttttttcaatatcagtgcccacaccttactgagtattgagttttagagctttcgcttgatgtgcttgaccaagagacttcttttgtatccttttcttgtcctatgatgtaaataaaagcctcgatttatgt

SEQ ID NO: 1118 - DNA, 2973 bp, Homo sapiens
agtctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgccgaggaggaacgggagttagggggttagcagcttggcgcgctgggagccggccacccctggtctccggacttcacttcccaggaggcctcgcgcgcgactggaagtgctgcgagcctataagaaggcgaggcggcacccgccgctctgctctggggcggcattgccagccggctgtaggcattcagggcagtgtcttctgcatctcctaggaacctcgggagcggcagctccggcgcctggtagcgagaggcgggttccggagatcccggcctcacttcgtcccactgtggttaggggtgagtcctgcaaatgttaagtgatttgctcaaggtgcccatttcgcaggaattggagcccaggccagttctctgagcctatcattagggctaaaggagtgcgtgatcagaatggtgtctggacggttctacttgtcctgcctgctgctggggtccctgggctctatgtgcatcctcttcactatctactggatgcagtactggcgtggtggctttgcctggaatggcagcatctacatgttcaactggcacccagtgcttatggttgctggcatggtggtattctatggaggtgcgtcactggtgtaccgcctgccccagtcgtgggtggggcccaaactgccctggaaactcctccatgcagcgctgcacctgatggccttcgtcctcactgttgtggggctggttgctgtctttacgtttcacaaccatggaaggactgccaacctctactcccttcacagctggctgggcatcaccactgtcttcctcttcgcctgccagtggttcctgggctttgctgtcttcctcctgccctgggcgtccatgtggctgcgcagcctcctaaaacctatccacgtcttttttggagccgccatcctctctctgtccatcgcatccgtcatttcgggcattaatgagaagcttttcttcagtttgaaaaacaccaccaggccataccacagcctgcccagtgaggcggtctttgccaacagcaccgggatgctggtggtggcctttgggctgctggtgctctacatccttctggcttcatcttggaagcgcccagagccggggatcctgaccgacagacagcccctgctgcatgatggggagtgaagcagcaggaaggggctcccaagagctcctggtggtgcagcctgtgctcccctcagaagctctgctcttcccagggctcccggctggtttcagcaggcgactttcttccaatgctgggcccagacttcttgcctgggtgctggcctgccctctccggccgcttgctgcctgtctgctttccttggtggctttgcctgggtgctgggcctgccctctccggccgcttgctgcctgtctgctttccttggtggctttgcctgggtgctgggcctgccttctctggctgcttgctgcctgtctgctttccttggtggctttggcttctgcactccttggcgtcagcctctcaggtcctccattcacacgaggtcctcctcgctctggccgctcttgctgctcctgtctgaagaaatcagactgatttcctcttaaggctcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccgtctccataggggtaggcatttcactggtttatgaagctcgagtttcattaaatatgttaagaatc

SEQ ID NO: 1119 - DNA, 2982 bp, Homo sapiens
ataggacgattccaaggctgcttagccccagacatcaggaaattcagttacttccctagctacgttgacaaaaatctagaacttttcagagagaagagagtgctgatgtactgtaccgggggcatccgctgtgagcggggttcagcctacctcaaagccaagggagtgtgcaaggaggtgttccagctcaagggtggcatccacaagtacctggaagagtttcctgatggcttttacaaagggaagttgtttgtttttgatgaacgctatgctctgtcctacaacagtgatgtggtgtcagagtgttcatactgtggagcccgctgggaccagtataaactctgctctactccccagtgccgccagctcgttttgacctgccctgcctgtcaaggacaaggattcacagcctgttgtgtcacatgtcaagacaaggggagcaggaaagtttcaggccctatgcaagacagctttaaagaggaatgcgagtgcacagcccgacggccacgcatacctagggaactcttgcagcatgtgcgacagcctgtgagcccagagccagggcctgatgctgatgaggatgggccagtgcttatgtgagcagcacctttggcattttcccaggccctcggtaaaagtaggtttggggtgactatacagagaaagcatggcaagactgcagaaacagagaaatcgggaacttcagttctggccgctgccaccgtggcagccgtctacacttcacagcgggaggggaggagtcacgttgtctaccacttacctgagacattctgatttggatgatgctagagcacagaaaataggtgagctgcatgggatcccaaagctgctgagggatagagcctgagcctggtggccacagcatatgccctttctgttccatgcagctggggctgttagtagtcattgcccttgtcagcagaccttctaccctggtggcaaacacatgaaagctgtggccctgggagtggcctcctaaaacaagccacttaggtcatctgccatctacccttaacctctgtctctcgcctgaggggaatctgcaagctgtgcattgggcttacctcctgcttttgtagaaataaccatcctttggtatacatggaggatagttccagaacgcctgagtatacaaaaacccaatgcatactcaagtcccacagtgggccctacagaacccacgtatgtgataaatcagccctccatgtacgcaggtttcgccccctgccaatactgtattttcaacctgtatggttgaaaaaaatccatatataagtgcagccatgcagttcaaacccatattgttcaagggtcaactgtatagtttattgaacagccacacccattcctttacacatgatctatggcagagttgaatagttgcaacagacactatgtggcctgcaaaatcggaaatttttactgtctggccttttacagaaaagtttgccagcccctgatctagaccagcagctcatctgatagaggcagaggtggccttaaagatgtggccttcttcattttctgttggtttggtttcgtttctatgagagatttcctctgatagctctgctttccccagcacttactctctgagcttttaaatgttctctctgggagcttcatataagctcggtgacatttgagccacagtttttagatcagcacctggaatacatgacacattcttactgaggtcatccagcactgccatggtggctgcccagtcttctggccagtgtgccaggcacatgtccctgtcacacaggttccaagaaacacatacgcagccatgcatagaccaacagatttaatattatattgcagttttcagcgatgcagaatgcagctgcaattgtgttttaaggagaagccaaatggggatggttgtccctgcaacatggtgccactcctgggccatgtgcagcctcagtggacactcttccatagcgctgaggccctggccccgcctccagttaccctgtactgcccactgccttacagttcagtgcgcaggccttcaccttttcatcaccagcctctctgctcagtgctctggagttcttgaccttgtcctttatcatgagatttgctgaaatcactaatgaaaataactcccaaaagcaacaaacaaaaatattagtttaactggcactgtggtatattaaaaggcacaagggcattgtggcttaacacttttgctggatcccaagagacgcacatgatgttaaaaagagatctggcagcagtactaatactacatttcagtgtaatcatcttggggtggtttggccaggatttcccaattccttgatatctggagtttcttcaccattgtccggcatcctgcggaggcttaatatacaggcgtaaggtcagcagcaatttgtctaataagtgatgagatcagtagctgaagtctctaagctgggccattactaaataccatagccatgttgatctggaaatttatccctctagtgtcttacctcacataagccatttgcccactgtgcaatatagaaaggtgttttcaaaagtatttggccgtagattttcacatccatcataaggttggcattcaataaggaaaaagttctaactccagtattaaattgtacataaatcccaaatgttcttaaagaacactcagggacatgtttgttgcctgggattggtaatgaaaggttggtttttgaaacttgaaatttcaccattggtttttttcctatcatttctgcatatccagcaaaaggaatctcatgttgactcctggcagagttcagtggcttcagtctgtctatctgttctgaggggaaaattgtgttctggatccagtaatcaatttggcaactttaatcgaggttttcaaaattccaaggagggttaataaagaatgataatcagttttatttgctaatagctaagacaaatttgtaataaagtgttttataatacttc

SEQ ID NO: 1120 - DNA, 1945 bp, Homo sapiens
gatttggaggcctcgcgtggggagagggccgcgtctgtggaggagcttggctccgcacctgctgggctggcgaacccgaaattgggcttggaacccgggagccagatcttggaccctgaactgcacctctgtcaagagcccaggggagaaagaatggctgtttcagtagcaatgtccaagctctgcattctccagactctgtgctttcctaagataggaacccagaagaggactgatcatttcttgcagctctaaaaaccatggctcggaaattagtgatgttcagggatgttgccattgacttctctcaggaagagtgggaatgcctggactctgctcagagagatttgtatagagatgtgatgttggagaactatagcaacttggtatcactagacttgccttcaaggtgtgcaagtaaggacttatctccagaaaagaacacttatgaaacagaattatcccaatgggaaatgagtgacagacttgaaaactgtgatcttgaagagtccaattccagggattatttggaagccaaaggcaagatggagaagcaacaagaaaatcagaaggaatatttcaggcaagggatgatcatatatgacaaaatgtccattttcaaccagcatacttacttatctcaacattcaagatgtcattctactgagaaaccctataaatgtaaggaatgtgggaaagccttcagacgagcctcacacctaacacaacatcaaagtattcatactggtgaaaaaccctatgaatgtaagcaatgcgggaaggcctttagtcgtgattcacaactcagtcttcatcagagacttcatactggtgagaaaccctatgcatgtaaggaatgtgggaaggcctttactcaaagctcacaacttattttacatcatagaattcatactggtgaaaaaccatataaatgtgaagaatgtgggaaagcctttattcgtagctcacaacttacccgacatcaaaaagttcatactggtgagaaaccttatgaatgtaaagaatgtgggaaggcctttactcagaattcacaacttacactacaccagagacttcatactggtgaaaagctctatgaatgtaaagaatgtaggaaggtctttactcagctctcacaacttattctgcataagagaattcataccggtgagaaaccctatgaatgtaaggaatgtggaaaagcttttatttgtggctcacagctttctcaacatcagaaaattcataatggggaaaaaccatatgaatgtaaggaatgtggaagggcctttattcggggctcactactgatgcaacatcagaggattcatactggtgaaaaaccctataaatgtgaagaatgtgggaaggcctttatccgtggctcacaacttactcaacaccagagaattcacaccaatgaaaagccctatgaatgtaaggaatgtggaaagatgtttagtcatggctcacaacttactcaacatcagagaatacacactggtgagaaaccctatcaatgtaaggaatgtggaaaagcgtttaatcgtggctcactccttacacgacaccagaggattcatactggtgagaaaccctatgaatgtaaagaatgtggaaaaacctttagtcgtggctcagaacttactcaacatgagcgaattcacacagccttccttgcaggtcaacaagatagaagtgatatttatatgagtaggagatttacgaaatccatttttcctgtctttttttccgtgcctacaatgtggacatctaagctggagctccgttactctcatggggactttgagaatggtatctgggtgttatggatcatggagcagaaatacagaaggagtctgcaaccctgatgactttgtggaacagccatactagctctggtctgcttgcctcctgtttctctttaaataaaattaaacatctt

SEQ ID NO: 1121 - DNA, 2083 bp, Homo sapiens
atatccaggagcttatgaagcactttaagaaagaaaagagtgaggctgagaatcatatcaggactctgaaggctgaaagtttagaagagaagaatatggctaaaattcatcgtggtcagctggagaagttgaaatcacagtgtgacagactgacagaggaattaacccagaatgaaaatgagaacaaaaaactgaagctaaaatatcaatgtttgaaggatcaactagaagaaagggaaaaacatataagcattgaagaggagcacttaaggaggatggaagaggccagattgcagctcaaggatcaacttctttgcttggagactgaacaggaatccattcttggtgtgataggaaaggaaattgatgcagcttgtaaaacattctccaaggactcagtggagaaattaaaagttttttcatctggtcctgatatacattatgacccacatcgctggttagcagaaagcaagactaaacttcagtggctctgtgaggaactgaaagagagagaaaacagagagaaaaatctgcgacaccagctgatgctctgcagacaacaactcaggaatttgactgaaaacaaggaatctgagttgcagtgtctctttcaacagatagaaaggcaggagcagcttctggatgaaatacatcgtgagaagagagatctactggaagagacccaaagaaaagatgaagaaatgggatctctgcaggaccgtgtaattgcattagaaacgagtacccaagtggccttggaccatctggagtctgtggctgagaaactgagcctactagaagatttcaaagacttcagagattcctgcagttcatctgagagaactgatggaagatattccaaatacagggttcgcagaaattctcttcagcatcaccaagatgacaccaagtacagaaccaaaagtttcaaaggtgacagaacctttctggaaggttcccacactcgtgggttagatcactcatcctcttggcaggatcacagtcgcttcctgtctagtccaagattttcatacgtgaactcatttaccaaaagaactgttgctccagattcagcttcaaacaaggaagatgccacaatgaatggaacaagttcacaacccaaaaaagaggaatatgggagctaaaaaagcaaatgtaatttgttattttacatgagtatgttacaaataataacatctctattcttacagcaatttggcccagattatctaacagacatacctgcagctttggctctttggtattgccaaacattgacaaaagtgacaatactgttggtccttgtgaatggtaaaccaatccaaataatatcagatcatgaatgatgtgcagctaatttatttgcaacttatactagcacagaaagaatgatattttttcactttgtattttcctttttcaagtgtggtcagtcacattttcccaaccaaaatttggatttctaattgaggccttttaaaaattactggctaaaaagaaggaaaatgagtttcccttgaggcaaaagttgccagcactttagattcagggagcatttatatacaactgattttttgaaaaatgctttctccctaataaattatcatgtgttataacatgtggagatgtgcatatataacattagacagtccactttataaatgctcaggacttttatatctatcatcttaacagtccgcaactgcataccgtagctgaaaattatttccaatcatccatttttaatagcaataaagaattcataaatgatatctgaactgtagagcactgtaaagaattcatagcacaatttatttatttgtctttttgtggccaaatatcctactgtgatcacttcagtcatatcctggaccgtctttggtttactgtgactaaaatcatagcaccaaactcctttgtccatgagatttatatataatcttgtataatttggtcctatctgcttctaccatcccaacttttttcatcaaagtgtctaagaacgtattccctttacacgctgatctcctagtggagaaggatttatattaaatgctaagtaatagtaaactttcaggaactg

SEQ ID NO: 1122 - DNA, 2440 bp, Homo sapiens
gatttgggagttgggaggtgagatgattggagtgaagagagttaatgtcatggaaaggaaaagctgtctgaagaaaagtacacattttaatgtccctcttcagccgtgcctgctgagagctctcctgggatgataagtgaaagtgtttggatttttttttaagttttaaaactctgccaaagcattgctcagtgtatctgggcagccccttccggcaaaacgcagcagtagcagaggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgtttaagcaaattcacatggtgcacaagccgggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccgccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccaccccctctcccaacaactccgacacctgttccaagggaacctggccggaagcctctttctagctcccgactcggagaagtcactggtagcccctcccctccgccccggagtggcgcccccacaccaagctcgcgcgccccggctctgtctcccacccggcctcctaaaaagcctctggactatgttcaagatcattcttctggtgttttcaatgaggcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttctcccccatcaagagcaaaagaccgtgagtcccctagaagttactcatccactttgactgacatggggagaagtgcaccaagggaaaggagaggaactccagaaaaagagaaattgcctgcaaaagctgtttatgattttaaggctcagacatctaaggagttgtcatttaagaaaggagatactgtctacatcctcaggaaaattgatcaaaattggtatgagggagaacaccacgggagagtgggcatcttcccgatctcatacgtagagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatcccaggaaccaacagacaaggcgtcttccctgtttcctatgtggaggtcgtcaagaagaacacaaaaggtactgaggactaccctgaccctccaataccccacagctattctagtgataggattcacagcttgagctcaaataagttggcttccagtgaaccagcccctcctcccacccacaaagtctcacctggctcagataaaggagctctccggggaactggccagggctggttgtccctgacagcctcatgtctaccagcaatgcagcaaaacccagtaatgaggtattttaattttgtctgattatggaagaactaaccggccttaccatgattagctattagagttaatcatattaataaatacctattttgactaacagatttttttaaacaaaaaacacaaatactatataagatgggggtggagtgggtatatgaaaacacaccatatttaattaaatgatgtaaatatgtgatataattccattatcccatttttcttcaggaccataaacttatattgtaaaagtctttgtaattgatatagtctttgtaatcttccaatattaacaatgatagctaatagtggagctcttactgagtatcagacactattctaaaaactccacatctttaatcgtcaaaacccagtgaggtgtgtgacattatcatccccactttagagaagaggaagttgatgcccagaaatttgtcctattccaggatgagaaactgtacaccatacctttgacataacggcactttgcaaaaataataatgctaataataaacaaaaacaacagaaaagaaaaacagc

SEQ ID NO: 1123 - DNA, 1955 bp, Homo sapiens
atgcacacagatatacgcacacccacccacatgtgcatggacacgtgcacatgcacacacggatgcacaagcatgcacacatgcacatgcacacacaaacacgcacatacggatacacacgggcatatgcacacaaacatgcacgtgcacacccacatgcatgcatacacacatgaacacgtgctcaacatatacatacatgtagatatatgcacatatccacatatacatacatatatatgcacattgtatgtacagtacacacagacatactctccccacgagagagagagtgactatgcacggtgttctacattgctggtttttatttaataatatattaactcattcattcgcaagcattcattgagcacctactgtgtgccagacactgctagagccagaagatgcgaggcccacagcggatgcaaatcctgtcctcacaaagcttgtaccctgttgggggaagacttaagtggggagcaggtttggggtgggaagtcagttggattctctgggggtgagtacactgctgtgcacatgtgcatctgcagaagcgtctgtgagatgggatgctgaagacatgggattgggggtcccactccagaccttaatgtggtcggaatgtgggtgttttgtcccccctttctcacctgccaggtcttgtggggaggggatcagcctcccacctgggtgaagctgggagagggccagactggtccatggccccagcttggatctttgcacacaatttctcccctgagcctcaggctcctttttgtaaattgggtgtagtgtgtcccccttggagagttgccctgagggccgagggacgaggtcagagtggagtgggtggtaacatgagcagcaggggtcacaggagtgggggcggaggccacagccaatgtctcctgagtgcttgggcaggcactgttgaagcctcatgatttatgtccattcttcctccacacggtgtccacacacccatttcaccatgaggaagcaggcacagatgccccccgcctgagctcacacagccagggggaggagggctgggttccaaaacaagtctagatgggctctggggtccagctcacaggcccactcagagtgggtgtcaggcgactgttggtcaattccttccttatctggtggccccatcagcctggagaggaaggctcttcctgaatcactcagtgaggcttccatgcccctcttttccttttatcagctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtggatggactgaagtgtgtatattttcttgatctattttttaataaaaaggaaaaggagcagaaggtg

SEQ ID NO: 1124 - DNA, 1258 bp, Homo sapiens
agaccagcccctgagcctcccgggtgctggcagctgtcatggggctaccctgggggcagcctcacctagggctgcagatgctcctcctggcgttgaactgtctccggcccagcctgagcctggagctggtgccctacacaccacagataacagcttgggacctggaagggaaggtcacagccaccaccttctccctggagcagccgcgctgtgtcttcgatgggcttgccagcgccagcgataccgtctggctcgtggtggccttcagcaatgcctccaggggcttccagaacccggagacactggctgacattccggcctccccacagctgctgaccgatggccactacatgacgctgcccctgtctccggaccagctgccctgtggcgaccccatggcgggcagcggaggcgcccccgtgctgcgggtgggccatgaccacggctgccaccagcagcccttctgcaacgcgcccctccctggccctggaccctatcgggaagacccccggatccatcgacacctggccagggcggcgaagtggcagcatgatcgtcattacctccatcctctcttctctggccggcctcctacccttggccttcttggcagcctctaccatgcgcttctccagcctgtggtggccggaggaggccccggagcagctgcggatcggctccttcatgggcaagcgctacatgacccaccacatcccacccagcgaggccgccacactgccggtgggctgcaagcctggcctggaccccctccccagcctcagcccctagcctggcctctttgcatggggctgggggagatggggcgccgggagtgagtgcatggtgctttgtcccagctcctgcacccacaggccccctcagggctccttgcctttcccccccaccagcacaccccgtaccctgcctggaatcccagcaccagcccccctgcctctcctctgcctttctggtttctctccctctccaagcatctgcaagttgcactcaggagggtttaggggagggccatgggcaggctggtctcgtgatagtgagtgagtgctcatgggatctggttgtttagaagcatgcagcacctcctgcttcactctctctgtctctcctgctccaccatggccagaaacgtacctgcttccccttcgccttctgccgtgattgtcagtttcttgagggctccccagccatgcttcctgtacagcctgcaaaactgtgagtcaattaaacctcttttcttcat

SEQ ID NO: 1125 - DNA, 1609 bp, Homo sapiens
attacctggggagctttaaaactatatgctaataatcaggacactctaggccaatgagaccaatctttgaagcctgtgagcatttccactcgtctgccaaggcagagacagccccatccagaagcaagaatgagacctcggggccctggcgcccttgagccaaccccatctctgttctcacaacttgccttgcctgacctctggagaaaaacttcagaaaatatcaccctttcttcccacctgctcccgctggccaaaatccccatcaaagcctggcttcagcccctcagactgggaactctatccaaatggagtgtggggagtgtgggtgaggaaggacggaaggaagtaggtcacacgctggctaccgcacaacggggaagaggccaacctcggaaaggcagaagagtggccgccatgccgagcttccagagatggagagaaggtctaggaagccaccttggggaagccgcctgagcaggagcggggcagccagggatcagagcccacggcctgctggggacccatcctgggcacggggctctgggctctgtgcccattctctgatgtgccacattgttctgctacttccttctctggaagtaataagggggttgggggtgggacagcacggccaggagtagatggagcggggtggagctgccagtgggggaggaggctgcggttcattcccacgaccagctgcccttctggccgccctgggactgcgtgggaaaaggtctgggaagtatgggggatggtgtgtgtgtgtgtgtgtgtgtgtgtgtgtgtgtgtgtgtgtgttttcatgtgtctgactcccttgcttggcttcagtcacaggacaaagccctttgagaaacagtcaccaacctgtgttcccactgggctctgtcctgggagaggcacaagaacccgccctgacgcctgagagaaagactctgaaggcctcaggaccaaatccctggaggggtcttggcgtctaatgaatctagattgactgacttccctgggatgcttctggaaccttctgctaagccctcagcttcttggcagagctctattactaactggatatcagaatatgggtgcaaactagacatggggagtgaagtcagccattctcacagcatctacctaagaaggccaggatcctccacagccacgtagatcgtagagccagtggcatgccggggatgatatacaaagacaagaaactctgaaacagagaacacaaactaacagcccataggccaaatgcagcccgcaggcacatggcttatttggccaacacagcatttaagaaatgtttgagccgaggctgggtgaggtggctcaggcctataatcccagtactttgggaggccgaggcaggtggatcacctgaggtcaggagttcaagaccagcctggccaacatgacaaaaccccgtctctactaaaaatacaagaattagccaggtgtggtggcccatgcctgcagtcccagctacccagctgcttggggggctgaggcaggagaatcgcttgaacctggggggcggaggttgccgtgagctgagatcacaccactgcactccagcctgggcgacagagcgaaactccgtctc

SEQ ID NO: 1126 - DNA, 1456 bp, Homo sapiens
cactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcatgagctcagtgagaagggccctgtattcacctccactgcccccaggggctgtggacaaaccggctgggggactgcccagcctcccacctgtttatttaacttatttcagtgctttataataaaggaaacactaac

SEQ ID NO: 1127 - DNA, 2218 bp, Homo sapiens
agatgctggggagcccctcactgccctgaccgactccgcagtccccggggaggagcatggatggtgtgtcggcagctccgtccttccagctgtcccgttgcagtgcccgtgatccgcgtctgccttagcaggggcctgcgtgagtgggcacggtgtgggaggtcgcctgcgtggggtggtgtctgtgtgtgtgcacgcacgcctgccatcaaagcagcagggctgagggggtgcagcttgctggtgttcactgggggagggcctgtgggcacacatggcagagagagtggctcacacgtcgtgaggtctcccctgtgctctggtgacccgaggaggtcgtgcagcacagcgcagaagcccctgcccacgggatccggccccccagacaccgaccccacaggccgtcccggatctcagcggacacaggcaggagcgccccatcatttgacggtgagcaggattcaggctgtgtgtcctggagctacttctcaccaactgtggtcagtgcagggggaacgaggaggtcttttgggggcctggcgaggggaagggctgctgcagtctagggagagggggtgcagcctgggggatgttggtggacatggatgtggaggtggaaggaggaggacgttgcgtggagtggtgggaggaggcgggagccgtgtgcgagagcaggtggaaagccttgaggggcaggaccaggatgcagctggcttgtagaagagctcaggagtgagcctggcactccagagggcgcggcgggtggggaggcagcaggcaccagtccaggagagcttcgtggacgtggctcctgcgcgcacacccccaggagcacagccacgggctgcaggtgtggctggcctcagcactcagtcctcacccggagcctttgcctgctcctccttccaagagcactgaggcaccagtgggcttggcactccaccttgggcttccttttcctggagagccgccttgagggtccctcctgtgactggggtctctgcagcgagagccgcgggggttgcggagcccctgcctgggggagctggcggaatgcgagccgccggccgggggccgccacataagacctgcaaggtggtgcctggggccctggctccttctcggctgcccctgcccacccagtaacagcccccaccagctacagagcccaggcgggtgccagccacgctgggagggcagaggacagacagccccggggctgcgacttggttctgtgtctactgttagaagttgagtgggaagctgcaggcccgccaggaccactgggtccctacagagcaaaggcctgcgtgttcccaaacagccgttgcccccgtggccgtggtaggtaatccatattggatgtcataaggaccagggggatatttaaagagagaaacagaaaatatatagagatataaaattatattcacagtttatctacagatttttcgtaacaatctttcttttccagtttgatactgtaaatctatcagagcagagccgggggcacgggcacaggtgggagttgggagcaaagcggaggcccgggctgcccgccgtcccccttcatctccccacggactgtaccaggcagctgggccccgcaggacaggccgcagcgggtggccggttctgtcccgtcttggggttcttggtgtccacgtcttgtgggccgtgggcttctacctgcccttggcctgcagtgctttgctggagaagggactccctggtccccagggtggacggagccgctgtcaccgcccagagctgggccggggaagcacggtgtgttctgcttttcttttcagattgttgaaatttcattgtcatgatttaatatatggatttttttatttaagaaaaagacgagggactctttgtcacgtgggtttgttttctgtctccgtgcctccggcttcccaaagagatccaggtctttgcgtttccagggcgtggggaccccggccccctatgccgccacgccgccacaccgcctcaccctggcttctgtgctacttggcagttccatttcattatttattttttgtgctgctttttatcatgatataaattattgaaaacagatcacatgtgggcccgtgtctggccgccgccgccctgccccgtccctgcggccactacctaatttattgccgtgcgtcctgctgctgtgactgcttttgtacctttgcaataaagaattttctggtttcag

SEQ ID NO: 1128 - DNA, 1783 bp, Homo sapiens
aagaatctcagctccagctgggaggggaccctcagcggctcagcggctcagccgtggtggcatctaccctccctgtttaaagaaggaatctgagatgtacttctggactcacgggcctggggcccacccagcacagatctctgctgagcaatcttgtctccactctgttcctgccctttgcccagccctgggcctccaatctgcattgattacctggtctgatctctctcaccatcactaggtacttaataaatatttgctgttgatgatagcaatgaccttgagactgatgaacagtctggccaagaggatccttgatgtggaagatagaaaaagcctttggggtcaggcagacttggattctaataccagccagttctgcttgctgtgtctgagcctcagtttactcatctgtgaagaggaggtagcaagaatgaaaatgcctgccttgtggtttgttgtaaggacagacactgccaacgtagagggcccagcagctcacagaccagttgctctgagagcagaccactcttgccttgatggtagggaactatttttgtgcgtggcaagtgggaccttaggaaggaaggcaactgtgaggcttctgagaaggaccctacacaagggagtttcctcccagggcaggtgaatggagagggtggcagaagcctacgggaagggatcacagggatcagctagagagtgccaccacccttcctggggaatgcagggcaaggtccctggtgggagttttcctgggaagccaaagaagcgcccaacaaagacagaatcaacatttgggtacctttggtacccagaggcagcaatgccaactacaaccacactggaagaagaagaccttctccgcatagattctctgatctcttcctccttcatggcaccagccctggggaaccagcatggtggggaaataatgaagctggaatacaaccacttacagacttcacaacctcctcctgtagataccaaagggattttaggatcacattttatttctcacctgagcaagaaaagctacaggagcatctcaagcagagggcaggagtctccagaggagttcaaggggctctggcaagaaaaatcaaggggctgtgttcaagaactggctcccttggtgattgtattacgaagcccatgtgtgctggatgctgatgaaattgctgccaaatgcctgtgcagccttggcaaggccctttatttctctgggtctccatttctctctctctcttttttttttttttttttttgaggcagagtctcactctgtcgcccaggctggagggcagtggcgtgatctcggctcactgcaagccccaccttctgagttcacgccattctactgcctcagcctcccgagtagctgggactacaggcgcccaccaccacgcccggcttattttttgtatttttagtagagacggggtttcaccgcattagccaagatggtctcgatctcctgacctcgtgattcacccacctcagcctcccaaagtgctgggattacaggcatgagccactgcgcccggcctgggtctccgtttctctagctgtgaaatgactgttctaaaagagccctgccggactttggcagtctgtaagaagacctgagttcttctctcagttccaagcaggaaaattgaacgtaccctgagcccggagcctgcaacaaactctgggcagcctcaggaagtcaggcagtgaagtcggaaaaatgatctcttctgtatagggagaaaataaaagtttaaaaatttgtagtttg

SEQ ID NO: 1129 - DNA, 2496 bp, Homo sapiens
tgataacaatctgggagttaaacacatatgatcatccctgctttacaactgaaaaacgaggcctagagatactatcatcatatacacctgaaaaacgaggcctggagcgatggaggagcttgttcaaggtcagagccagcactcatatatgggtcttaagacactggagcagccaagggcctctagaccaggacattccactcggagcagcagctcaggggccaccaggcctctgtggcagggggacctctgtggcaggggggacctctgtggcggggggggggcttctgtggcaggggggtcacagcccaaggaaggggagcaggcccaggcatggtttccgtttctgggagccaagagccttctcagaagagggggagagagctactgcatggaatcatttgggccctggaggctgatgggtacttgggggagcaatccctggtgaccccaaccagcaagacaagtgccctgtgaaggggaagggactacagctgatcaaaggagcaggcaccagtggccgggcctcccgtctgcccctcatcctccaggctctggcgggaaggagcaggaagggctccctgcccttggggttttgatcagtgaggaggggggcttgggtctgagtctgggtctgggtctgctgccgaaacactgcccccagtccctctcctcactagactctggggtctaggcgtgtctttgtggtcggccttctccaaaccctctaggcctctgtctgcagctgctgctgcctggacctatacacaaggtcccacccctcaccggggccaaagacgtggttgcaggccctggtggatcctttctgttttgctccatccccgtcccctcttgcacccagcatcgtcctggtcagaacttccgtttaaaccttccttgcctgccgtgcactccgaggggggcgtcactttgccataggccccagggctgaaaatggcgggacatccagtattgggctcacgtgcataagactgtcccagacagcagcacaatcacgttcagccaagtggagtttccgacgcacttgtgtggcagccgcgtgaatgtgagccgatatgcagctgggaggggttgtgggcctcctgcggtgaggggctcctgccaggagctctgagaagcctccacagaatcagccgtcgggctccttcagcagcagctccccttatctgtgccaacgactgggggcctaactcaagggtgccagcccgtcttccgccaatacagactgtgggattctgagagttaggagcctggggtcccctggggtggggtggtcagggtgagcaggtgggctctgtgagcctgtttccccatgccctgactcaccccaatccctgggtgaggacagagctcctgaaggccactgaaggaggtgcagcacactccacctgggtggccttccgcagctcagccctcttcctgccagcaggaagcctctgcctgcgctccttaagttagccatcctcaccccctccgggcagctctgagactgagccagggccactagcagcacccagacctcgacccttctcagaccgaggcgccaccaccccaggccgaggaggcaaggagggaagaccaaagtctagaggactgtcttggtggccctgggcgagtcttgaactttggtgccatcatctgcaaaagggaggaaagaatgcctgcgtggtgcagctacgtggatacgcagtgaagacccgcatggtgggacgcctggcacttaacaatggtagcatttggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaacaatggtagcatcgttttcagtgcccaggaagaaggcagctgggacagggaaagggccaccacaccacacccaagcctatacaacaggagagccactttcagcagctctgagcaggacagacttgtggccaagtcaagaaagtaaggtctggtcccagcgaggtggctcatccctgtaatcccagtgctttgggaggccgaagcgggggcggggtggatcacttgaggtcaggggtttgagaccagcccgaccaacatggtgaaaccccgtctctactaagaatataaaaattagccgggcgtggtggcgcgtgcctgtaatctcagctgcttgggaggctgaggcaggagaatcgcttgaacccgggaggcagaggttgcagtgagccgagatcgagccactactgtccagcccggcggcagtgtgaggctcggtctc

SEQ ID NO: 1130 - DNA, 1698 bp, Homo sapiens
atttggacggcaccgacgccgcggagacgaaccctccaaccccactccgccaggaccgcctgccaacatcctcccagggaatgacgcctcgcggggcagatgcgtcctacacccagggctcctcaaggtgccggcagggcctgtcggtgggcctggcttttccgcagaagagcaatcaacaagtgtctcctcttgccagagctccctcccgaattcaggcgctgtgacagcttacctcaatctatgctcaatgcttctgataaaatcccttgagaggaccgagactggttcaatatactcagtgagccgagaagggacattttccccggctgtcctgcaaaccctcctcctcacatcgagctcggcgggggttggggaggctcagcaggaaggaatcctggggagaagccagggttggcaccccccgccccccgacgcactccttctcaggccagggccctctaacgggtggcagccgtgaagctcccactcctccccagagtccccgccgacccccagccctaggcccggcccctctgcacaccacgctcccgccccgcggcgtccaccctcgagccccctggccaggttaccatgctggcggggcggcctgctgcgctcgaggggctctccgtgccccctctgcaccgccccccggaggaggggtgctgggtgtccgggtgtctactcctgcctgtctctgcagcggagcttagcagagttctcggtcggagaagcgcaccaggcagcggcaataactgcgggcccggcgtacggcagccatcttcgcggggcagggggccagatcggggcgcgctggggtggcggcggctgccggggactcggggagtggagggacgcccgttgccagccgaggcgggggattgtgcgagcaccggagcgtcagccctactggagaccccggacgccgccgcggagctgccccctcagctgcggaaacctgcgccgacgcgccgagcatgcgcagtgccggtgctgcccgtgtgggcggcccggccacccatccccgcgggctgcctagtggagggctaagggtcgcggacctactgtgtgcgcgcgcctgacgcggggggtgaggctgcccgggtgccgaacctcaagcccaacccgcgtgttgggctgagtgaacacttaagcgaacttgaacaagcattacctcaaaaatttttacaacccaaatttaggggtgggcccttaaagcaagccgccctgagaagcatcgaactggacgcttgggacagtcgctacaaagtcctcggagcctctggctagagtcccgcgccaggaatgcaggaaaacagtgaaatttctcaacagtcacagttgttataacgactaaagtttttgagagcacagacagactggagattgaggaaaagacgcgctttggcgcccagcaggaggaaagagccaacgcaaggcatgtctcactacagatcccataatgcagtgcgaaaagggcttgcgattccatggccctgaaacccaagtgccgtggagacggcgcccgcgaggcactctgggatttgtagtcggccgctcaggtttgagcaccggaacttacacttggtcctcggccccacctcttaaagcccaaactacctgatttcttcttgagtgaatgtacttgttcataaggtgatactttgcttttacacaatttaaatctttttaact

SEQ ID NO: 1131 - DNA, 2090 bp, Homo sapiens
agggtgagggagggggtgggatgggtggggggtaacgggggaaactggggaagtggggaaccgaggggcaaccaggggaagatggggtgctggaggagagcttgtgggagccaaggagcaccttggacatctggagtctggcagggtttgatcccagggcctgggcaacggaggtgtagctggcagcagcgggcaggtgaggaccccatctgccgggcaggtgagtcccttccctccccaggcctcgcttccccagccttctgaaagaaggaggtttaggggatcgagggctggcggggagaagcagacaccctcccagcagaggggcaggatgggggcaggagagttagcaaaggtgacatcttctcggggggagccgagactgcgcaaggctggggggctatgggcccgttccaggcagaaagagcaagagggcagggagggagcacaggggtggccagcgtagggtccagcacgtggggtggtaccccaggcctgggtcagacagggacaaggcaggggacacaggacggaggggtccccagctgccacctcacccaccgcaattcatttagtagcaggcacagaggcagctccggcacggctttctcaggcctatgccggagcctcgagggctggagagcgggaagacaggcagtgctcggggagttgcagcaggacatcaccaggagggcgaagcggccacgggaggggggccccgggacattgcgcagcaaggaggctgcaggggctcggcctgcgggcgccggtcccacgaggcactgcggcccagggtctggtgcggagagggcccacagtggacttggtgacgctgtatgccctcaccgctcagcccctggggctggcttggcagacagtacagcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcgggcggcgacggagccgggatcggtgcctcagcgttcgggctggagacgaggccaggtctccagctggggtggacgtgcccaccagctgccgaaggccaagacgccaggtccggtggacgtgacaagcaggacatgacatggtccggtgtgacggcgaggacagaggaggcgcgtccggccttcctgaacaccttaggctggtggggctgcggcaagaagcgggtctgtttctttacttcctccacggagtcggcgcactatggctgccctctgggctcccagaacccacaacatgaaagaaatggtgctacccagctcaagcctgggcctttgaatccggacacaaaaccctctagcttggaaatgaatatgctgcactttacaaccactgcactacctgactcaggaatcggctctcgaaggtgaagcgagaggaaccagacctcatcagcccaacatcaaagacaccatcggaacagcagcgcccgcagcacccaccccgcaccggcgactccatcttcacggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcggtgcgagtgtgcgtgagtgtgagccaccttggcaagtgcctgcgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcaccaataaacactgttacagc

SEQ ID NO: 1132 - DNA, 2214 bp, Homo sapiens
aaatctgttccgctccaggtttcgcttgctaactcagcgcaccaagtcccctgcctggatctcactccacctttcaatcaaagctctaaaacttctttctatttctacaactgctcttctctaaaccaaacctgttgtccatgccctgaaggacactgtgacaggaagaacacctctgaggagggattccccagtcccaccatccaacccatgagcttctccccagctaaacaaatgaacgattatcgagacaagtcaccccaaaaccgctgtgcagcttgggaaggaaaagagctaatcacatggagggttctatatttgcttcccaaggcacacactgtccccacatggccaaaatctactgttcccctgggagggcctctatcccctgcatgcaatcaaactattccagcagggtggaaatcgcagttacacaagtggttcgacagccacatcccccggtgggcctgtacccctcctggctatgtatttttatgtgggccacaaaaaaaataaactgccctttgatggaagtcctaagataacttattcaaccccccctgtggcaaacctctacacttgcattaataacatccaacatacgggagaatgtgctgtgggacttttgggaccacgggggataggtgtgaccatttataacaccacccaacccagacagaaaagagctctgggtctaatactggcagggatgggtgcggccataggaatgatcgccccatggggagggttcacttatcatgatgtcaccctcagaaatctctccagacaaatagacaacatagctaagagtaccagagatagcatctctaaactcaaggcctccatagattctctagcaaatgtagtcatgaacaacagattggccttagattacctcttagcagagcagggtggagtctgtgcagtgatcagtaaatcctgttgcatttatgtcaataacagtggggcgatagaggaggatataaaaaagatctatgatgaggttacgtggctccataactttggaaaaggtgattcagcagggtccatttgggaggctgtgaagtctgccctcccctccctcacatggtttgtccctttactgggaccagctgcacttaatagcctgctttctcctctttggcccttgtctctataattcactaattaaatatgtctcttccaggatatggcaatttcacacagagcccctaaaaatggaaagagatcatccaatcttccttggaggtcccagcacctacaagtacatatctcccttggatgccagtgggcaaagattctgcaactacggaggggctccttccctgacagagagcaagagagggagaccctgatgacttcttcgtcccacgtcagcaggaagtagttacagaagacccacgacgtccttatgcccaaagcttttcagggtctccaactcttgagggggaatactgttagggtaggcaggtagccagacaagagcaggcaaggaagcccctgggaaaggaatctttagaaatgcagcccgctgatggcctccttggaaacgctgcacgctgagtcagcaaaaggaggagcgtggctacactggctacacctggccttgtggctgcattcctctgttccagaagggaacttatcaaggcccagccagaggttaccaaggtaggagctattccccactaagaagcatgtatacttctctaataattcaccctaatataccattttgttcattaaaataataaaaaaaccacacacctgtgtggagattttattttttaaccagaaattccttgttagactttagatccaaatgacatggcacatgtgtgcccagaccagttcccaacacatgcttactagtaacgcccctgcatgaccccttcatgaataatcatgtaaaattctcataagaagcatctccccagccaggtgtggtggctcacgcctgtaatcccaacactttgggaggctgaggcaggcagatcacctgaggtcgggagcgcgagaccagcctgaccaacatggagaaaccccgtctctactaaaaatacaaaattagctgggcgtggtggcgcatgcctgtaatcccagctacttgggaggctgaggcaggagaatcgcttgaacccgggaggcagaggttgtgttgagccaagatcgtgccattccactccagcctgggcaacgagaggggaactccatctc

SEQ ID NO: 1133 - DNA, 1932 bp, Homo sapiens
agagccgagcgaatcccgagcccgggcagcagaggccacatgagctgtggaaagcacattacctgggaccgggtcacctgagaaggtctttgtatcagatgttcctgggatcaaaggcacagtggaatgagccccaagttggaaccagaaagacctcagcaggtagcagacctgaagtgcaagtgaaagaagccaatcttagaaggctgcatactgtatgattccacctatttgaccttctgaaaaaggcaaagctacagagacagaaaaaaaggcacaaagatgaccttgcacatctgctgcagatggcacctccacccagctgtccccagcacagcattgacttgtcgagagctgtcctttgagtctgatggattattgagactttttgaatgcaggaagcacactcatggggccatccaagggccttgcattatttttctgcctttgaaaagccactgaactaaatttggcagataaaaatatgcctgagagatttctttcttaatttgctgattatgagccctgaccgtaaggagcttacggtctagagtagatggtatgtgagcataaaccactacaacacaaggtaaactatgattcatagtctgggagaggtaccgttgaagtgggcaagagagagaggaaatccagcccctccccactggcctcaagtggaagcagtgacaccagttctgaaagtttggattggagggccaggtaggagtgagactcctacccactcctatgaaatatgttctgggccaggcgcggtggctcacgcctgtaatcccagcactttgggagcccgaggcaggcggatcacgaggtcaagagatcaagaccatcctagccaacatggtgacaccccgtctctactaaagatacaaaaattagccgggtgtggtagcaggcgcctgtagtcccagctacttgggaggctagggcaggagaatcacttgaacctgggaggcggagattgcagtgagccgagatcacaccactgcactccagcctggtgacagagcgagactccgtctcaaaaataaaaaataaaagaaagaaagaaagatgttccaagcagagagaattccataagcagaggcagagaggtgaataattgtgtgtgcacatgcactaggaacagataggtggctggagcacagtgtagagaaggataaggaatggcttaaaaggctggggccagatggtggaaggctctgaattcctggccaaggaattgagagcatgttcagtaagcagtaggcacctctgcaggtttgagtcagggaataagcagatcacactgcgcttcagaagagtcaccaggtggcagcgtataggatgtgcctgaagcaccgggcacggtggctcacgcctgtaatcccagcactttgggaggctgaggtgagcagatcacaaggtcaggagatcgaaaccatcctagctaacacgatgaagccccatctccactaaaaatacaaaaaatgagccgggcgcggtggcggctgcctgtagtcccagctactcgggaggctgaggcaggagaatggcgtgaacctgggaggcggaacgtgcagtgagctgagatcgtgccactgcactccagcctgggtgacagagcgagactccgactcaaaaaaaaaaagaaaaagaaaaggatgtgcctgaagcaagatgcccagcggtaagaacacccatcaggaggctacttcaaggcagttacaaggacccagacagttggaagctgtctcttctgcgtctgcactcccacggccctttatcagtacttctcttaggtacttaccaatttttaccttatctacatttttaattaaaaatagttgtggttcattataaaggaaaattagacagtatagaaaaatataaattgtaatcccaccatccattaaataactactgttgacactc

SEQ ID NO: 1134 - DNA, 1502 bp, Homo sapiens
agctgcgtccttagcgggagcccgagtgcgggcggtggcgggcttggcggcggggcaggattccaggcaggagccttgcctctcaggtggcgggctctgcgaccctgcgagatggacgggacagaaggcagtgccgggcagcccggccccgctgagcgatcccaccgaagcagcgtgtcctccgtgggagcccgagcggctgacgtgctggtatacctagcggatgacacggtggtgcccctggctgtggagaacctgccctcgctcagtgcccatgagctgcaccgcgctgtccgcgaggtcctgcagcttccagacatcgccctggatgtcttcgcgctctggctggtctcccctctgctggaggtgcagctgaaacccaagcaccagccctacaagctgggacgccagtggccggagctgctgctgcgcttcaccagtgccccagacgatgacgtggccatggatgagcctttcctgcagttccgaaggaacgtgttcttcccaaagcggcgggagctccagatccatgacgaggaggtcctgcggctgctttgattccaggtgattttattttttttatttttttattttttttgagacggagtcttgctctgttgcccaggcaggagtgcagtggcgcatctcggctcactgcaacctctgtctcaagcgattctcctgcctcagcctcctgagtagctgggattacaggtgcatgccaccaggccccgctgatttttgtatttttagtagagatagggtttcaccatgttgatcaggcgagtgaagccgaagcgcaccacatccttcttcagccggcagctgtccttgggccaggggagctacaccgtggtgcagcccggcgacagcctggagcagggctgaggacgctgcacccggcaggaggagggcgactgggggccctggcccggcactgtcctcctgaggggcaggcgccggctgcaacagtctcatgggtcaccacgtggggagggctgcctcagcaggtttctcagaccacggagaagtgacttttgggcccggggccatgcccgggctgtgcaaagctggccagggcctcctgtagggctcctctgcagcctgccctgccttcccccggatgctgggccctgctgctctctcaggaccatccgatcaagctgcagctgccaccctcacctagaaacatgcctttgtgcccacctcaagatgggcagtgtcccaaagtgctgggattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgttttctgagcatccgttgtgccttaacattttctgcttgtcctttgggacaaagcagtattttactcattctttgaatgttctcattcttttgtatcatgtgacttattaaaatcagtttctaac

SEQ ID NO: 1135 - DNA, 1588 bp, Homo sapiens
aatcatagaactcagtccctgcatttctgctgggatcttggcttttcagtcggaggaaaattctccaaaaacattctccatgtgaggatgagcaaatatgaagggatagcattgttgccacgttcattttctgtctgggcaaggccatggggtggaaagagccaaagctaagctgaagctccacagagctcacaccatgttatctatttgagggagtgggaggtgtttgaagactaaagccaactctttttggctaagaatcttttctttggtagaacttctgtctcctcccctctaggaggatcaccatctcacattttaaaagttaggtgctctttgtatgcgaggattgggattgttaggggcctgtgttcgtgatgatcactatcatggagccatttcttgttgggaattgttagagggtaagatcagagataggtacttagttcaagaagaccctctgaagctcccaaactgtagatatgtcctgtgtgcgaactggctggctttacagaagtcctgatggaagtgggtttattgtttttttgactcgttaccaaccctctgcttactccttcccctcaaaaaagggaagctgacttctcaggttagccagcagctcactcatacttttttctctctctattccattggctgatctgctgacttggggctctgaatctggatactctccatcaccggttggctgctgtcaccatttccttcctcgttgatggcactactagtggtcaagcagaggatgcagatgtacaactcaccataccaccgggtgacaggctgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgagcgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaatt

SEQ ID NO: 1136 - DNA, 1814 bp, Homo sapiens
gcttctgccactcaatggaggacggtctgctggagatcatgaccaaggacggcggcgacatgccggcgcccctggaggtgtccaccgtgccggcagtgggggacgtgatctccggggagtacaacggcggcatgaaggaactgatggagcacctgaaagcccagctgcaagccctgtttgaggacgtgagggccatgaggggggccctggacgagcaggcctcgcacatccaggtgctctcggacgacgtgtgcgccaaccagcgagccatcgtctccatgtgccagattatgaccactgcgccccgccagggcggcttgggcgtggtcggcggcaaggggagcttccagagcgacccccaagagccggagactccttcgcctgggatcggggacagcggcttgctgggtcgcgatcccgaggacgaggaggaagaggaagaagagaaggagatgcccagccccgccacaccctccagtcactgtgagcgccccgaaagcccctgtgctggtctccttgggggggacgggccacttgtggagcccctcgacatgcccgacattaccctgctgcaactggagggcgaggcctccctgtgaggggactccgtggggcactaccttcccgggctgtctttgggtttccgagtgcatgacgcgagggggactgaacggcgcggtgcggcatgcttcacttggacagctgctcttgtgggtcaggcagagagagactccctcgaggaaggatttgtagggtgaaggactttgggagcatcgagaattctttctgcccaactaagcgaattatagcgaactgcggaaaggtgaggctccgggagaggaagcgcccatctctggactcccatccatccctatcctgtcctttcccccttcccagacaacaggagaacccgtgaattgtgtaaataaaattctgctttttctattctgaaaaaggacttacctaggaccatggcaaataatctctaacaatttacctggaaattaaggaattgggggtattttgttctggcaacaggaaatttacccttctgctgaaatccaagatattcagtgctctgcagaagcctctccccctcacagatctctgcggctgctgattggtaaaggaagcttgaggagggaactgcagccctaggaatctgggtgaatggggttccaagggcccctgggctgggaggagctggctatgaatgtgcatgaagacataatagctcaacctctaggattttgcatgcagagcggatcctgccttgtcactgacttcatctgggattgcttttccactccctggggcttagagaacaaagagcccggttcacaggcagagactcgggggtgctcagcagcagcccagatttaggggacatttgagggactcttggggccgcagccaaaaactgtctctcctggctacacctgcttaacttcagttcctttttctgtcaatatgtccttgcccactgcctctcggtgttgccttcataatgtcttgtgtgtgttatgtgtgtctacttgtgtagtagtgtgtgagccctcaggggcagggcttgtggctctggtgttaggttcaggggcttcagacccttctacgagctccaagctatcaatggcgcttttctctccctcttcccccaaccagggcatggagcatgtggctgtcctgaggttcttttactgatgtgccgcccttccacctcctcaagtggtgattttgtgtgccctccccctcctttgtgtattccttctcaatgctttccttggtgtcaaccttaataaaaaggcgtcatctcc

SEQ ID NO: 1137 - DNA, 2297 bp, Homo sapiens
gactcctcatcacaaaaggcgcgaaagtgaacggtcggcagaagaacgggaccaccgccctcattcatgctgcagagaagaactttttaacaacagtggctattcttttggaagcaggagcttttgtaaatgtccagcaaagcaatggtgagactgcactgatgaaggcctgtaaaagaggaaattcagacatcgtacgactcgtaattgaatgtggagctgactgcaatattttgtcaaagcaccagaatagtgccctgcactttgcgaagcagtctaacaatgtgcttgtgtacgacttgctgaagaaccatttagagacactttcaagagtagcagaagagacaataaaggattactttgaagctcgccttgctctgctagaaccagtttttccaatcgcatgtcatcgactctgtgagggtccagatttttcaacagatttcaattacaaacccccacagaacataccagaaggctctggcatcctgctgtttatcttccatgcaaactttttgggtaaagaagttattgctcggctctgtggaccgtgtagtgtacaagctgtagttctgaatgataaatttcagcttcctgtttttctggacagtcattttgtttactcattcagccctgttgcaggtcccaataaactcttcataaggttgacagaagcaccctctgccaaggttaagttgctaataggtgcatacagagtgcagctgcagtgaccaaacagaagggactgggcggagttctcttcagaccgattcctatactctctttgacagcagtttggaattcttctagcacatctatgtaaagttttgtctgtaaacctcttgcagttaagcctgttgtctgttgtagtctgtaagatgcgacatagctgtgtctgtgccagtatgccggaatctcagtgcagtgtccagactgcgtatttcagtttttccacaatgtggatagtacatatgaggattatttaagaaaattaaagacttcactttcttttttctggagacggagtttcgctcttgttgcccaggctggagtgcaatggtgcgatctcggctcactgcaagctctgcctcctgggttcaagtgattctcctgcctcagcctcctgagtagctgggattacagacacccgccatggcacccagctaattttgtatttttagtagagatggggtttatccatgttggtcaggctggtcttgaactcctgacctcaggtgatccgcccgcctcggcctcccaaagtgcttggattacaggcatgagccaccgcacccagcaagagttattttcttaacttgaaattttctactagccctggtgaacttctgtgcttaaaaaaaaaaaaaaaaaaggaaaaattcagctctaaaacatttgcttacagcaagggagccatgttatattcaagttacccaagcaccaaataaagtgtgggtttgctgcccttgaaagggttgggaggcctgatctttttctagtagacagttgccacacattccccaagcacaaaaggtggagatggcagtcactttgtaaatatgctgtagtcacttatcatcttttcaaagggtaacaagagaatctaagatgtagtaagaatgtaaaccagtacactatgagacctaaaagagagtattaaatgtgaacttttagcagagcgtggtggctcacacctataatcccagcgctttggaggctgaggttggaggattgcttgagtccaggagttcaagaccagcctgggtaacatggggtggaacaagcctgtagtcccagatactcaggaggctgaggtgaaaggattgcttgggccagggaggtcaaggctgcagtgagccgtgaaaggccactgcactccagcctgggtgacagaatgagaccttgtctcaaaaaaaaaaaaaaaagtttcttggaacctatacggtttttttttgtttttttttttgaaaagccagaccttgtgcccttgttttgaacaccgactgggaagatggggcttaggtaacagccaaacctggctgtcagctgtgtgggagccaccaccctctctgggaagagttcctgcttctgtatggcaagcataaatcaagctcagtctgggttatggagaagttgaaaattgttttgttcctcattagtttataattgtatgaaatacgattttaatgaaaacttttcagaattcacgtttgtgtagatatttcagagaaccatttttactttacatcctaaaactgccttttcctatggttttgtcaataaaacactatgatgtt

SEQ ID NO: 1138 - DNA, 3076 bp, Homo sapiens
attcgctgtgtgactcagggcaagtgtgcgcacctctgtgagcctccgcggccttctctagcaaaatggtggagccggtacccggctgtaaggcaagctgggatgcgcggagtagcgggtggaaagctggactggagttctcactcggccgctgggtgacttcggtgcactagggatagtaacagtaccacctcgtagggttgtagaaagaccaagtgagttaatatttgtaaagtgtttagaacagcgtctactgcatggaaagtagtatttatttgttagagagactccaggaggtcttgcccagggattgacttctcccttccctgtctccaccccccacattcccgtttgtgagccaagccttgcttttgcaccggccgggctctcttgcctagaaatgcatacccatctcaaacctgggctttaaaatcacctcctctgggacgccttcctctacttctcacagttcaggcctgttctgccccacacagcagaaaatgcccacgatgcaataccagagtctgcatgggaccatttcaacaacccttagaagctgactcagctgtctcctggccctgacttttctaagatgagaggagctgataggaacaatttgggaaccctcaaaggctgagagtatcccacccacttcacagatgaagcaaactgaggcccagagaagggaaattacttgcccaagatcacccagcaagtaagaaacagagctggagatgagctcaggccagcacggaaccacgcaaactccttctgtaggctttgtaaaggattgatgagaaaagcagatggttaagagctctacaacttctgtgaggtaaagaatatctgcagggctggacgtggcggctcttgcctgtaatcttagcactttgggaggccaaagtgggtggattgcttgagtctatgagttcaagaccagcctgggcaacatggtaaaactctgtctctctaaaaaaaaaaaaaaaaaaaaattagctgagtgtggtgttgtgtgcttgtagtcccagctactttggaggctgaagcggaaggatcccttggcccaggaggcagaggttgcagtgagctgagattgtgccactgcacttcagcttgggtgacagagccagaccttatttaaaaaaaaaaaagggatatctgtgattacaagattacaatgcaattttgaaagcctgctgttgcccagctggacagctagagttattctcagtggtgggatggctgaactgggggcccactgtggagagctggtttcccactggagttctctgaaaaggtgcctgatttcacagctctgattctacagaaggaggccggacccttcacgtaattgctaccctttatttatggagctattcctctgtcgggatgccctttatatgtgtacagtctgtgctgcagtcgattcttatagtgattctatgcagaaggtactttagaggaggctgctggggcgcagggtgggtaggtaccttgtcagcatggtggggctgggtctccagctggttgggaccccaccctcctatcatggcccaggagtgaggcattcagggctggaccaccagcatttgtgaagctttgtgccccattatcccatcagaacatcttcttggccctggcaggcagccagggcagggccattctccaccttactgacaaagaagcccagggaggggaagagggtgctcccccaacacctccattgcctctgcctgcttagtccagaatgcaggatagagaaataatgggaaaagctcccaagtgttgctggatctctgcctgccagggaagctgtgaccccagtaagggcagggtgttccttccagggaactcgaggtggggcaggatgggtagggagtgagatcagagggaaggccatgttgggaagatgggaaggcaagtctctgggggtttgtgggatagaggaagggaacatcatagaacaggccaggaataggagcttgacctggagattactttgcagcaggtttaaacaggggccatgtgagagtgtggagccctggggtcagaggttactggatgcaaattatgactctgccacttatgggaatggtgagtttggacaaatgatttccctgggcctcagggtcttcatgtataaaagggctgaagctcagtgggtaactggagcactgcctgggttagatcctggctccacccctttccagtgtgacctagggtgaatgagttcacctctctgggcatcagtgtccttgtctctaagatggacttgataataatgaaagctacccctcacagggctgtggtgaggatgaaggggtctggcagcacatgtagaattcttagagcaggcttttttcctgcagagtctttgttgctatcatcatcatcatcatcatcctcatcctcatcatcatctacctccagggattcttggggggcttaaacaaggcaggttgtacaaattatctggcacagacgtcattaaataataacagggcagagtgacgggtgctgtgatacagggaagagctgggagagacacaggaaagagaaaagacttctgtctggctgggtggaagaagggtgtggaaggtatggaagccaagggaaaacttcccctttgccctctgaaggttcactgaaaagtcaactgacaaaaggcagatgaatagcagaaatggcatgcaaatttattaatgcgcacacagggagaaccacagaatgattgattactccccactctgcaatggggtgcagaagcttatatgccatcttgaggttacagaaagaatgggggcttggggcctgagcgcagtggctcatgcctgtattcccaccactttgggaggccgaggtgggtggatcacctgaggtcaggagtttgagaccaccctgaccagcatgaaaccccgtctctactagaaatacaaaaaattggctgggtgttgtggtgcgcgcctgtaattccagctactcgggaggctgaggcaggagaatcacttgggccagggatgctgaggttgcacgagctgagatcgcaccgctgccctccagcctgggcaacaagagc

SEQ ID NO: 1139 - DNA, 2107 bp, Homo sapiens
attccggtctcactgaccccggcccacccgcgggactccaggcacctcttctgcccgcaccccgcgacccctcccgggaccccggagacagccggcctgcccccggcgtcccccttggccagcacgccatgccggggctgcgccgggaccgcctactgactctgctgctgctgggcgcgctgctctccgccgacctctacttccacctctggccccaagtacagcgccagctgcggcctcgggagcgcccgcgggggtgcccgtgcaccggccgcgcctcctccctggcgcgggactcggccgcagctgcctcggaccccggcacgatcgtgcacaacttttcccgaaccgagccccggactgaaccggctggcggcagccacagcgggtcgagctccaagttgcaggccctcttcgcccacccgctgtacaacgtcccggaggagccgcctctcctgggagccgaggactcgctcctggccagccaggaggcgctgcggtattaccggaggaaggtggcccgctggaacaggcgacacaagatgtacagagagcagatgaaccttacctccctggaccccccactgcagctccgactcgaggccagctgggtccagttccacctgggtattaaccgccatgggctctactcccggtccagccctgttgtcagcaaacttctgcaagacatgaggcactttcccaccatcagtgctgattacagtcaagatgagaaagccttgctgggggcatgtgactgcacccagattgtgaaacccagtggggtccacctcaagctggtgctgaggttctcggatttcgggaaggccatgttcaaacccatgagacagcagcgagatgaagagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaaaccacacctgctggagggttccctctctgccttcctgccgtccctcaacctggcccccaggctgtctgtgcccaacccctggatccgctcctacacactggcaggaaaagaggagtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagtcggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtgg

SEQ ID NO: 1140 - DNA, 2034 bp, Homo sapiens
atcgcttgtcctgagctggttgccggggcaggggcggaggcggaggcagaggtggaggcgctttgaaagccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacggaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtac

SEQ ID NO: 1141 - DNA, 2582 bp, Homo sapiens
acaaccataaccataccttcaatgggtatcacctccgctgtggacgataccactgttttcacatcaaatcctgccttctctgagactaggaggattccgacagagccaacattctcattgactcctggattcagggagactagcacctctgaagagaccacctcaatcacagaaacaagtgcagtcctttatggagtgcccactagtgctactactgaagtctccatgacagaaatcatgtcctctaatagaacacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctccctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcaacacccattttggataccagaatgacagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctgggagcagaaaccagcacagctcttcccaggacaaccccatctgctttcaatagagaatcagagaccacagcctcactggtctctcgttctggggcagagagaagtccggttattcaaactctagatgtttcttctagtgagcctgatacaacagcttcatgggttatccatcttgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccag

SEQ ID NO: 1142 - DNA, 2698 bp, Homo sapiens
aacgttaaatttagatgttttacctctaaatgaggtgaaattgcaggttccctctggctggcggtggggaggagacgcagggcagctttggccagcagtgagcggacagacttagcgggagtagactctgcttcctccagccacaccttggggacggaggcccaggacagtccccagtgtctgggagcatctggcttcctctccctgcacacaccagccgggtctgaacggcatcagttctaagtgccaggccagagagaggcagcgagggacacggagtagaagaggctgtcctgtctgccaccaaaggtgaccaccatgtcggtgaggttgcggttcctgtcccctggggacacaggggccgtgggggtcgtgggccggagcgcctccttcgcaggcttcagcagtgcacagagccggaggatcgcaaagtccatcaacaggaactccgtgagatcgcgaatgcctgcaaaatcctccaagatgtacggcacgctgcggaaggggtcggtctgtgcagacccgaagccccagcaggtgaagaagatcttcgaagcattgaaaagaggcctcaaggagtatctgtgtgtgcagcaggctgagctggaccacctgtctggacgccacaaagacaccaggaggaattccaggctggctttctattatgacctggacaagcaaacgcgctgtgtggaaaggcacattcggaagatggagtttcacatcagcaaggtggatgagctgtacgaggactactgcatccagtgccgcctgcgcgacggcgcctccagcatgcagcgggccttcgcccggtgccccccgagccgcgcagcccgagagagcctgcaggagctgggccgcagcctgcacgagtgcgccgaggacatgtggctcatcgagggggccctggaggttcacctgggcgagttccacatcaggatgaaaggcttggtgggctacgcacgcctctgtcccggagaccactatgaggtgctcatgcgtctgggccgccagcgttggaagctcaagggtcggatcgagtcagatgacagccagacctgggacgaagaggagaaggccttcatccccacgctgcatgagaacctggacatcaaggtgacggagttgcggggcctgggctcgctggctgtgggtgcagtgacgtgtgacatcgccgacttcttcacgacgcggccgcaggtcatcgtggtggacatcacggagttgggtaccatcaagctgcagctggaggtgcagtggaacccgtttgatactgagagcttcctggtgtcacccagccccacgggcaagttttctatgggcagcaggaagggctccttgtacaactggacacccccgagcacccccagcttccgggagagatactacctgtctgtcctacagcagccaacacagcaggccttgctgctgggtggcccaagggccacctccatcctcagctacctgtctgacagcgacctccggggtcccagcctaagaagccagagtcaggagctgcctgagatggactccttcagctctgaggacccccgagacacggagaccagcacgtcggcgtccacctcagatgtgggcttcctgcccttgaccttcggtccccacgcctccattgaagaggaggctcgggaggaccccctgcccccaggtctcctgccagagatggcccacctctctggaggcccgtttgcagagcagcctggctggaggaacttaggaggggagagccccagcctgccacagggctccctgttccacagcggcacagcctcgagtagccagaacggccacgaggaaggggcaaccggggacagagaggacgggcctggcgtggccctcgaggggcctctgcaggaggtcctggagttgctgaggcccacggactccacccagccccagctccgggagctggagtaccaggtcctcggcttccgggaccggctgaagccctgcagagcacggcaggagctcacctcggccgagagcctgatagagtgcatcctggagagcttcgccttcctcaatgccgacttcgccccggatgagctgtccctgtttgggggctcccagggtctccggtgagtgcacctccttccagcagtgacccagtggccaccactcccaccgggtgacccgagctccacgtttcctgccagcctccccgtctgtttctcccactgtccttggctcagctcttgtcactctatcgtgcacccttccccatgccatccccgcacatcccccacttgcctcagagccggtcctcagagaccacgaagtgggtgagatcaccccagcctgcccctgagccttctgctccaaggaaccagcttttagtattattttttaaaccttaaaaataatcaccaagtatatagtagaagttctttgaggccaggcacagtggctcacgcctgtaatcccaacactttgggaggccgaggcaggcggattacctgaggtcaggagttcaagaccagcctggccaacatgatgaaaccccgtctctactaaaaatacaaaaattagctgggcatggtggcaagagcctgtaatctcagctactcaggaggctgaggcaggagaatcactcggacccgggaggcggaggttgcagtgagccaagatggcaccactacatttcagcctgggcgaaagtaagactctgtctcaaaaaaag

SEQ ID NO: 1143 - DNA, 1778 bp, Homo sapiens
aactggcctgtgtaagcggatgggctcggcctcaaggacagggtgctcggctgaaaaaaaagctagcggcgatcaccggtgccagggctctccagaaacggagcccatctaaccaatgcccagcacactcgctctgctccacacacgagaccacctccgacccgcactaagttggccaactgcactctggaggcggcggcagccagcgagggagaagggaaaggctgtcccgggaccccgaggaggactgccccgcccccgggaaccgggtgcggcgtaaaacaaccccggctccgggccgacccttcctggccccttggaggcccaggcggggcggcggggggcgacgcggcaggggtctccgcgcccaggctcccgcggagcggccacacgtggaggttcccactttggggtcgcggccgcagcagcaccgggcgggatgctgtccgcgctgcccgcgtacggccgcggcctgagtggagacgcctgcccccagccccgaggcctcggcccccgtccgccctctctccctgctcggcggcctcgtactcacgctgacttcatggcagcaggctccacgccgcccaaacgcgcatgcgggacggctggctggcgaagactgcgggacgttaggaccggcagcaagaactagaacttcgcggctaaggcgcggtgctctgcgaagccggcggcgacgctaagagcccaggtgagctcccgcctggcgcatttcaaacgggccaatcagcgcccgtccgcagggagaggcaggacctccgcggaagtgacttcgctgccggaagtggcgcttgtctcctaggcgaccgacgctgaaagggccgcggagtcgcgtgtcagggctggagggagatcttgagatcacttcaaacttaagtgagctcaggttcatctggaggatgactcggcctctgttctctcgtcccacctgacgagaaatacccacaggtgtggaggggctggcccccttcacctgggtctcgactcctgttttgttctgcggttcccattgcagtgctgtgaccccccagaagctcaggaaaacaactgacttcctggtgttgccaacaggcagagaggagatgcagccagtccttaccctgtagaagatggggagggagtcccaggtgtacggataagcaaaggcgaggacacgaatcaccttacagagtctgggcttctggatttcaagaaacctaaatcagggaaggaaagtggggaggaaatggaatgaaaagagtctcagcagattgcatacgcacatgcatgcacaccgagggcctggtcatcaacagaggacaagcatttttctacaagctcctgtggccagcagcttctccaccagcctcgtccattcctcccaccccaatggaagtgacaaaacttcagatgcaaaaagatctccagggacaccatctcctgaccatgggaagcagtggtgtccagactaagccagaaaggaggcgctgggcagaaacccttcaagggccaagttatgtaactgccaaagaaccttttaaaactctagttgctacagggacagggaacgggtagggggaatcgggggatccactgccacagactcttggggggcacactctgcagaggctgagatgcacccatctagttggagcccaggtattatcatgcaggagacctgggttcaagtaggtgtttgacccttggagagctttctggaatatttataccacacacagggatacttggcttgggaaaactaaataaacgtgaagtctttc

SEQ ID NO: 1144 - DNA, 1782 bp, Homo sapiens
aagagtccaccttgcgaccgtatccgctagcgcggcctgggatgcgcttgggctccctggtgaaaaagcaaaatataaaattcgattcaaactgtgattacatctatggaaaatacagcctttgccgaccaccctctttgtcccgccgccctccgtgctcccctctgttttgtgtacggagtttcttactttgtacaagtccgcagccgcttatgttacagccccgaggccagatgcgtttaaaatcgaggagttctcggagtttggaaagttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgtatgtccttcatctctctgacctctgagaaagagaagcagcgatcctttctggctcgcctctgcattggttgctgagggtctgctgagaggtgaggagcggcgctgcagcgtgtagtgaatgagctggtgcaccgatggagaggacggtttgtcactaagtgatctaccacagaccagccactctccttccacccggctcttcccagcattgttcactggccatgcttggaggtgcccatggcagttctcatctttgcatctgtgtgcctgaaggtccagagaatctttttccccaggcggttgggggaaagatgagagctacaggctgagaggtgaaatcctgtggcccctcacaaacctccccagccccgtgtcctgcccaccagcccttccttcttcccagcccagggtctgctctcttgggccagctccactcctgcacccccgtctcatccagggcctgccctgccctgtcctcagtgctgtgctagcaggaccgcccgtccaccctgtctgtcgggagggctgtcagagggcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggaacaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtctgtgtttcaggttccacgcgagtcacctctttcgtcttaatgttcaccgtccacagctttggaataaaccatcctgggaagttgctgc

SEQ ID NO: 1145 - DNA, 3051 bp, Homo sapiens
gttcggccgcttcctcttggcgggtgggctgcagctatggagggcgagcctccacctgtggaggagcggcggcggctgcaggaggagctgaacgagttcgtggagagcggctgccggacgttggaggaggtgaccgcgtccctgggctgggacctagatagtctggatcccggggaagaggaggcggcggaggatgaagttgtgatatgtccatacgattccaatcatcacatgcctaaatcatctttggcaaagcacatggcatcttgtagattgaggaaaatgggctataccaaagaagaagaggatgaaatgtataatcctgagtttttctatgaaaatgtgaagataccttcgattactttgaataaggactcacaattccagataattaaacaagctagaactgcagttgggaaagacagtgattgttataatcaaataattggggtgagtataaagaggaattaggaacctgaatgtactccttatttaaagatatgcagtatcctttttgcaaatgatatccttttaaaagtaaaatttctaaactttatcttaatacctgtcacatattatagtcttgaattggaattttggttgaattacaaggaatttaagtatcagtcttcatcataaagaaatttaagatgaataaattgaagaaaaggctaaaataatttaagaaggaaattatatttctttgtttaaaaataacaggcaaaggtttatatgaagcttgtttgtaatacatcattattttctaatctgtgttttcctcccaaatttttatagcctaattcaaaggaattaggcttatcaaagctgtttttataattttgtattatgaaatgcctactataattagaataaaattgattgacttgaaagggaacccttttttccccattaattcaaaaccctttgacgagtaaaaatggccatatattgttatgtatagccgtgttaaaccatggcctcagattcactgcagctctcctcttaatatgtagacaagtagtacctcttttttgttgtaatgcttagttcatagtatgctcttatttgaattctttttgcctctacctaggaacttaatgaggttagactttatcaaatataagtatctggaaagagctactgattttatgttgttctatgaaccagttactactttagaataagttagcaaacaataaaaggattcctttagtagctcatgttctttgtttgcattagtgagtaatgaagtctagaaagaattgttttaaattgctttttttacagttccaatcatttttttatttgagaaaatttgaatctcaaaacaaaaattttcttcaatgtttaatacatcatatcaaggtattgtatttactttttttcactaatgagcagattttagaaaattctgtaactaccggggggcactgctattaacttttttcaattaatttggttaagccactatgcttcctcctcaggaaattaaaatgagtttaatttaatctgtgctttcctggcgtgaggaggtgtgggatttctgctacttaattattttgtggcccctagctctaagtccttgcacacgtgggatatattttgaatattgaccatctagcttgatgtctcatacaaaaagatattttttacacagtttttaatatttccatagtttattttcaaagggactgtaatgcatattacttattaaaagcattttttcccccaactttgatggggaaaagcatatcaacagatacctacttttgtagatggctataaaaattgttacccaaaaggctttcttagagcaaattgtctcttatgattattcctgcctgcctccatgggatctgtctttatattgttggagagaatagcaaacatccataatacatttttttttttttgtggatataacattcaggatagaattgtttgtcatttattgcttagattgatattttgtatacttagggattatgaaaaaagtttgtgttaatattgcattattaaagcacatgtttaaagataattattagattttaagttcacaatgcttcatgtattgtttattcttgtgattttatttttactttaggaatttattcttcattgcctgttgaagttcctttgaatcacaaacggtttgtttgtgatctaactcaagctgatcgtcttgccctctatgatttcgtagttgaggagacaaagaaaaagcgctctgattctcaaattattgaaaatgacagcgatctctttgtagacttggctgccaaaatcaatcaagacaatagtcgaaaaagtccaaaatcctaccttgaaatcctggcagaagtacgagattataaaagaagacgccagtcctatagagccaagaatgttcacataaccaagaaatcatatactgaggtgattcgagatgtgataaatgtgcacatggaagaactcagcaatcattggcaagaagagcaagagaaggcagaggatgatgccgaaaagaatgaagaaaggcgatcagcttcagtagattcacggcagtctggtggaagctatttggatgctgagtgttcacgacatagaagggataggagtagaagcccacataaaagaaaaagaaacaaagataaggataaaaactgtgagtcgagaagaaggaaagagagggatggggaaagacaccatagtcataaaagaagaaagcaaaaaatataaatgaagtacttgtacctatattaattatgcttacgccatgataaccaatatacagatatattaattggaattcctttgcataggagaatgtttttatgatctgtttagtgcttattattttttttatgatctgtttagtgcttattattttccagtaaatatgcttcaaaccatgagtacactattaggccctacaactttgttttccttatattttattagatgatttgcttcctataactgatgttgttttgttcgttttgctaatatatgtatctcaaaattctttaagtcaatatttatcatatgtaaattaaacatgaatacattctc

SEQ ID NO: 1146 - DNA, 2016 bp, Homo sapiens
tactagctgcctcatttaagtgaaaaatccagaagtttatatgttgtcatcatgactaacaagccatcaatcattgtgtgtaattatattctttaatttatccccatgttgaaatactggcattctctttacctcaatagtacatgcaaaagacacagtccctgccttactggtctgtcttctcagtgtgatgagagggtaatgaaaccatgtgggcatctgtagctggtggattaatgatattttagcatgagctttccattttcatgctgacactttctttaatagtggttattcttgctggtgtctagtgttagaataagcacactttattttttcctccccgaactcacctgtatccaaaaggaatacattgtaaaggaatgcatttaacttttcgttatgctgagttggagttggcatggcaaaaagatgttcttgaaattctcaacgtgatctctggtgccaggtggccgttcttcccattaacgattgagcgcctcttcttttccgtcttttctttgtgtgcattgttgtgtgtgtataacccagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccggccacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgc

SEQ ID NO: 1147 - DNA, 2039 bp, Homo sapiens
ctggcggccgttgaaaaatggcgactgtggcagagttgaaggctgttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcagatgaccacctaagaaaggaggaacagaaaagtactaacattgaagatcttcatgtttctcaggcagtcaacagataatgctttgtttggggtatcttttgtcttaaaattgtattattaattaaataacttatttattgtcccaatgttaccaaaatgcaccactaatgtttgtagaaattggagtttctacaaaacacccctcatgtttaactacatttgtgaataaaagctaactcttgtcatctagcttattggatttgacttgaaaaaaaaagtattgtttttacgaagtattttttgtttttttgagatggagtctcgctctgtcacccagactggagtgcagtggcacgatctcggctcactgcaatctctgcctcccggattcaagtgattctcctgcctcagcctcccaagtagctgggaaaacaggcctgtgccaccacaccggagtagtttttgtatttttagtagagatggggtttcaccatgctggccaggctggtcttgaactcctgacctcaggtgatctgtgtgccccagcctcccaaagcgctgggattacaggtgtgagccactgagcccagccatttaggaagtattataaaggcccttaaagtttgtaaggaaatgaaagggctttgtattaccttttcaataggcaacaatgtactttttctttccttagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcacacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatctgtttgtactgcggcaactttttatactttcaatgtatcatttaataaaaaaaataagcaagt

SEQ ID NO: 1148 - DNA, 2204 bp, Homo sapiens
acatttattctgctggatttaaaaatatgtactttttttttttttgagatgaagtcttgctgtgtcacgtaggctggagtgcaatggcacgatcgtgtctcattgcaacttccgcctcctggattcaggtgattctcctgtctcagcctcccgagtaactgggattacaggcatgcgccaccgtgaccagctaatttttttgtatttttgtagagatggggtttcaccatgttggccaggctggtctcgaacttctgacctcaagtgatccacctgcctcggcctccctaagtgctgggattacaggcgtgagccaccatgcctggccaaaatatgcaaatattttttatcctgtgctacctagaattacaagtagaggattgtttttacaattttgtcttgttttagtaattggggacaatgggataaaatgacatacaacaaatggttatcccacttgtatatttttttaaagactcttatcctgttacccttacataaaaccagttatgataattgtatgtttggaagataaattgtatgctgagccttaaaacccagtgtgactgtagaagatataatgcggacatgatttgaatttagtgacagcttggctgatgtcactgaaccagaagggtttatactgagtgaaggaaaggtaaaaagcagtattttgtatatttttgtaacaaaatataaatgaagatattttaccatgaagagattgcacttatccttgagaacagtctaaatataaatgaagatattttaccatgaagagattgcacttatccttgagaacagtctaatgatactttttttactttcagactgtttctagctaaagttctgataaaagtattgagttaatttaaactttcaaacactgtttagatcagttgaaaactaattcttaatagccattgttttataatctttagtttaaattcatctgtttgacatttggttttttgtgaacttgagtcagtcctattgaacattttgacctatattcttgcaaattatgttaatttttcatattttagtttgattttagacaattattttcaaaaagaaacctgactttttttcaccttcttgacattgtgagtgatacacgttaaaaggctatttgcccgcatcctcctctatcctgtttcgaggtagagagcttggcacttctgttacaagctgagagtctggaggtgctgagtttaacgtggctgtgcaggtgatttcaaggcatgagctgaacagcgttgacacagccgtgacttacaattaaaccctttcaattacagtacagattctgtgtgctacttgatgagatgttacccaaggccagtttggacttactgctttttgtccctcatattaaattatcaaatgatgccgatgaaatgcttgaaaatgattctgctctcaaagttatgcttccctagaaaggtgtcatgtcgggcacttgtgttgggtgactatgacatcccagcagtgctggtcaggtctcagagttgctttcacctagagctgatgcttccacaaggggacatttgtgttactttgctccaggggtctgtcataaaaacaatggtaactacttcatccctaggaagcccaagacttcagggcactgttagctgattggtaaataagggacacgatattcacgggaattgtttactgctccccactagtaattctcatggggccacttttttaactctttctaattaacacctcttctcagcatagagcagaggatgcagtcatttctctgttgaaatctatgtagtatttatgtagaatgtcattatatgaaaagcgaattcagaatcctaactctgggaaagcgctctctggaaatgtagtttgataatagtgtcttataggggccacgggaatttgtttctctataaagcgatgggctccagtgtcatgttaccagagttatcgctcagttttgtttgttaaggcttttgctagaacctattatgtatccagtttttaaaacatacttcattcccttgatagcagagatccagagcacagatggcaagttgtgtggatgatactgaatatgtttattttcctaaagataaatgtcacgacacgacatttctcagtttttatttagatgtttattaccatgtgttaacagaatcttaaaacccaagggatttcttcagtaaactagactttgattc

SEQ ID NO: 1149 - DNA, 1699 bp, Homo sapiens
gtttctacctggtttgttgtgaacctgtgttctccacatttgtcctgactcttcaggtgaataactgagcctttcacttggctttgctgcaacccttcagctctgtgcgtgttggaagcaagaattggataagacttctcaggcgtctgcacaatccctaatggcccccagatctgccaaggagaccttcaggataaacccaaatgtagcagcaaatttatgctgggttggattttgatcaccttggcaaccattgctgccttagtctcctgctgtgtggcaaagtgctgctctcccctcacctctctgcaacattgctactggaccagccacctccagaatgagagagaactctttgaacaagcagcagagcagcactctcggctcctcatgatgcatcgcataaagaagctatttggcttcattcccgggagtgaagacgtcaaacacatccgcattccttcttgtcaggactggaaagatatttcagtacccactcttttatgcatgggtgatgacttgcaaggtcactatagcttccttggaaatagggtggatgaggataatgaggaagacagatcaagaggtattgaattaaaaccttgattacagcacctttcatgagtcaggttgcttagcagatacttggcttttatggcttttatgatcaggccatttcaatgtaatctcttcatctttttctttctctctgatatttgtttacgtaagtccatctcaaatattatttctaaaatcaatctattagataattgtgccaatctctcattttgaaattttgccaatggtctggtaatgcctagagtggaatgtgaagtcacatggaaatttgcatcttagttctgttacttagtagctgtgtgaaaattaatatttctgagtgccgttttgtcatctgcacattgtagctacctcctagagctattatgagaattaaacatgataatacaaagtgtttagcacagtgtctttcataaaaatagatgctaatgaatgttactttctctctttctcttttgcattccatgtcttctattcaccattttccctgcctctattttctggttttatcagtttctacctttatataatgtccagaacttttcacagcctccccctctttcttcagacctaaatatctgaccttttgggaagcaggacagaaacctctttctaatccagtaacatgtgagggagaagcccatgcaggaagctcttgagttactgtactatagcattttattgttccacagctagttaaatgaaactttttcattaagaacatggtactccctcccctttatgcttaatggatttatgtaattataaaacatataattaaagtcaattatgtgctaatactactttatattttgctaccaaatgcttttggctaccacatcaaaccctggagcttgacatatataaacctgctcctttcttaatttcattagctcctccacgatcccatcatgacctaagttgccaccttcccaggagacaaatacaaaccaatgtgtaaatgtgttttactcagctttctttatgttttccaaagctgaattgtagaaccgcatttatactctgtccttctctgtgtctcttttctctgttctcagtcttccattcattttttgtagaaattctaatgcatgattgtaataaacaacagtgagatttt

SEQ ID NO: 1150 - DNA, 2240 bp, Homo sapiens
aagcccctctgggctgcctggacggatgaagtccaggtggaaagccagtcgacgtttcccgggagctacgactccagggaccctcatccgagcttaaccgttggaacaatcacaaacccagaaacttttagctgagtgttatttataaaaagcgctgttttgactactgttggacttggaaaagctttgcccacgatactgaagcgtaattagctgcctacttttcaaaattatgtgatgacttcatgggaaaagagattcacaaggaccagtaacaggaaagcttaaataagcttggaaatctttaaactttcaatatggattgaactttttgctgcattaccacaagattctctagtaaggcttaatagagctgaaacagaattcacaagacaggattctcactgactgttacccctgcgtcctctttctccttactgaggggaaaatgccaaagcaattggggaaaaaaatactgttttctctgaaatgaagactcctcaagatcctgttgctggaatgagtattggactcttcggtctacttctacagtcaccagtacatctggcatacactatgatgcccaacagtaggaagatgaaagaaatgtagatgttggcatttctaaaagagatgttgtatcttttttcctacttaatagactattaggctataaatctcaatcttggccagcaaatgtgtttgccagcttttctttattctttttaatttttttgaggatcagcatggaaaaacaatttgcgcaaggctcaagaagatgagatggtcttataaacagtaattgaaatatgtatattttttaaaagtctgtttcaaatttcaaaccttattttaaaaactatgtgaaagcctcttgtgaaactcaactgaagtaggcatggctgagtccagaggagcagtgtggaggattagaaaaataaacaggcaggagtcagacagtcctggattcaaatcccacttctaggccttagagaaataatataatagtaggggataataatattcaccctgaagagtgctgtagggatcatcaatatttcatataaagcatgtcatatgggcagtgctcaatgaatggcaatgcttttgcccaggtatagaacttcttagtataaaagttttgtctttcagaaaattgacaaagatattcaggaccggaattcagctctggatcaagtagacctgatagatatctacagaactttctatcccaaaacaacagaatgtacatttttctcattgccacatgtcacttactctaaaatcgatcacataatcggaagtaaaacactcctcagtaaatgcaaaagaactgaaatcataacaaacagtctctcagaccacagtgcaattaaattagaattcaagattaggaaattcagtcaaaaccacacaactacatggaaattgaacaaccttttccagaatgactcttgggtaaataatgaaattaaggcagaaatcaagaagttctttgaaactaatgagaaaaagagagaatgtaccagaatctctgggacgcagctaaagtagtgttaagagggaaatttatagcactaaatgcccacatcaaacagctggacagagctcaagttgataacctaacatcttaactaaaagaacttagagaaccaagagcaaataaaccccaaagctagcagaagataagaaataaccaagatcagagctgaactgaaggagatagagacacaaaaaatccttaaaaaaatcaacgaatccaggagctgttttttgaaaaaattaataaaatagacaactagctagactaacaaataagaaaagagagaagagtcaaataaacacaatgaaaaatgataagggggatagtaccgctgaccccatagaaatacaaacaaccatcagagaatactatgaacacctctatgcaaataaactagaaaatgtagaaaaaatggataaatttctggacacatataccctcccaagactgagccaggaagaaattgaatccctgaatagaccaataacaagttctgaaattgaggcagtaataaaaaacttaccagccaaaaagagcccaggaccagatggattcacagctgaattctaccagagtataaagaagagctggtacaatgtctgctaaaattattccaaataattgaaaaggagagactcctccctaactaattctatgaggccagcatcatctgataccaaaacctggcagagatacc

SEQ ID NO: 1151 - DNA, 2866 bp, Homo sapiens
ggaaaataagccaggagaggaaggagcggcgggcaggtggccccgggagcccagacggacggctgctgtcgatatggcgacagctgccctgtggccgcccctgcacccagatggcgcctggcctggccgcagcatcctggagtctgaggccagcacctgcgtctccctgaagcccctcagagcctgccctgcagtgctgctgccctcgtctaccagtggctcaagcctgtcatcccagcactgtgggaggccgaggcgggtggatcacctgaggacaggagttcaagaccagcctgggcaacatggctatatggaaagcacaggtgtttctgcttctggagaggccccaggaagcttccaaccgtggtggaaggcgaagcgggagcaggtgtctcacatggcgtgagcgggaacgagaaagacagagcagggaaacgtgcagaggaaatggttggagagcgaagtccaggcacaggggccatgagagccggaccccacgcagctgcagaccccgacccgaactgcatgcggctgaggacccccaagccaggcagaccccgacccagaccccacgcggccgcggacccccgacctcgacccaaactgcatgcggctgaggacccccaagccaggcagacgccaatccagaccccacgcggccgcggaccccaacccagacagaccccgacccacccgtgcagcccccagccccaaaagtcaaaccccagcgtccccccagggcggcccgggctccctcagatacagcagcttcctgaggtggcctcacccgcaactccagaccaatcagagaaggccaaatgggctccccaagcccagcaggtgggacccccgatctagagagccccttccccgccccaggccaacagccaccctcgggctccgcatcaggtctgccaaatgcaggggcgaggggccgaccccgccacgggaaccaaactcaggaaacagcccatccagcgtccatctccatccggacccgccgccgcggccgcaggttcacgcgccgttccgcggagatctctcaggcgcctctggcccggcagaaacccgcggttccgatgacagaggtcctggtgggaatcgcaccgcctgccgttcctgcctccgcggaggatgcgctgccctaaactgcccccggctcttcatcccccaacccccggcagcctccgaccctcccccggccggcgcagctcagcctttcgcagacgcgggggagctggaatccgaccacgcgcagccttctcaccgtggtgcacgcttcgggccccccacgcctttcccaggcttcatcacccatttctctccagcgctgaaggaaacctcccagatgcttctccactcacccaccgaagcaggtctcggttgcccccagccccgggccctcccgagaacactgcaagcccccactggtcccctcccggcaaccccacggcccatccccaaacctgcactcaccctgtggggcctccaccctttggaggaaggacgtgtcaaagcttggaggtgcgcggcctgtctaacctccgcccaaggcgcgcggcaggcgacaggtctcagcccggatcagcgtggtccaaaaggacttatcgttaaaagtgctggtcccagaacccaaggggaagacatgctggttctctgatgagctgggccgcctcctccaggaagcctcctccttggagctctgtagccatcgtgggcttgcaagagtcaaagggcctggcccacagcggcgcccggcactgagctggacagtgtcctgcccccaaaattcatgtccgcccagaacctcagaatgcaaccttccctggtagtagggctttgcagatgtaattaaggatctggggacgaggtcaccctggattgaggctgagtcccaagtcagtcactggtgttcctccatgaagagcagagcagaatagagacagatgcacagagcaggccctgtgaggacagaggcagggactggagcgtcggccgcagcaggggcgtggagcccccagagctggaagagggagggatcctccccagggcctccggaaggagtgtgctgcgtgctgcccacaccgtgattttggactcgtggcatccagaactgggagagaataaatttctgatgttgtaagcctgcactacagcagccccaggacgctgaaatagttcagccggtgcaggctcctccctccctccctctctcttgttgtgagatattttttagacggggtctcacctgtcgctggagtgcagtggtgtgatcatagctcactggagcctctaatgcctgggctcaagcgatcctcccacctcagcctcccgagtagctgggactacaggtgccatcagacctggctaatttttaaaaatctttttagagatgggggaggtctccctatgtggcccaggctggccttgaactcttgggctcaagtgatcctcttgccttggcctcccaaagtgttaggatggcaggcttgagccaccatgcctggcagctccatctgtgttgactcctgaagcccctcatcttggctaatccggacaggcttgctggggaccccatctccccttggagactttgggatgtggctggatgtccaagtggccggggtcctccacagcccccagcttcccagggcgggaggcaggctgtgtcctcggtgggcactgacagtgaggctgaaatgtttgcacttcacatttccacatttaggggcattttgttgttgactcattcaaagctcttttaagtcgcttaatttgctgctcagagggaaatgaaaagggagccattttccctgatttgtttgcctcatcaacttttcaatcaataaaaaagtgcattttgctc

SEQ ID NO: 1152 - DNA, 2434 bp, Homo sapiens
gagaaatacttgcagagccagcaggtagctgggcagctccttcccggacggacggatggacagacgctggggaccctccactccatatggaaagatgacatgaccttgtggtagatcccagaactgaggccccaggatgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcatgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctgggtgagcctgtgagaagaaagggggcatcgggaagtggacttgaggagggcagggcctgcctggtgtggggagcaggaggatttcccttcacttgacctgggcccctcagggtctcccaccccctgccagtctgcatgcccatctcctcccaggaccacctccaccccactgtgtagagcccatgcactgcccacagtgaatctgcccccagcttactgcctcttgcgcccttcccctgccttttctgaccctaccctgtttcccaactccacccagggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtgtgtgtaacaataaattactaccagtc

SEQ ID NO: 1153 - DNA, 2753 bp, Homo sapiens
attgttaacattgtttattgagttttgatactcagtcttcctgattcacttaacccataatggtctgtttctcaccagttattaaactgtgtctgcactgggctggcttgcagctgagcgatgcggagttgagcccaccttggttgatgagtgattaggtctcaggcaggcagggctgctctcattagagcagagggtgctgtgtcctggcactcctgggggtggatggtggacccccaattctgcccctcctggcctcccctccctacccagagccccttcacatcccatgcacagtccctctgcctgtgacatctctgcaccgggattaagagcctggctcttggagtctgcctggggtccgctagccatcacccctgggggtgtaagcgcttgagaaggtgtctgcctagggcccaccgtggagaggaacccccagactgcttctagaagccagggctgcagcctggggggtacaggcctagcagggagccacagtgacccctcccagccaatggccctgagagaacaggcagtggagccccccgcccccacccacagtgaagtgacgggtggtccctacagtggggccagaccctgagacatcacccctgagtgagtgcatctgtcagaccctgaggcatcgcccctgagtgagcgtatctgtcggcctctggtctgtgccctgggacctctccctaaaagcccaggcagcaggggccatggctggtggctagtcccccggggaggggctgcccaggtccctgcaccttgaaagtccgacgcagacatcttagggggaaggagcgtgtcctcccaggcactcgggatcctggggtgcagcccggccctcccccacaccctccctgtgctgcaggtcccgcacagtcgggcatcctggtggaccgcgaggtggtcagcctcttcctgcacttcaccgtcaaccccaagccacgagtggagttcattgaccggccccgctgctgcctgcgtgggaaggagtgcagcatcaaccgcttccagcaggtggagagtcgctggggctacagcgggaccagtgaccgcatcaggtggggcttggggtgcaggcgggggggtccggacatgggggtggaggactcggggatgacggagatggggggccgggcatgggggtggagaactcagggatgatgaagacggcgggggggccgccgggcatgggggtggaggactcagggacgatggaggggaccgggcatgggggtgggctcgccccagctcaccttaggctatccctgggtatccacgctgctgcctgtcatctgccacggcaggttctcagtcaacaagcgcatcttcgtggtgggatttgggctgtatggatccatccacgggcccaccgactaccaagtgaacatccagattattcacaccgatagcaacaccgtcttgggccagaacgacacgggcttcagctgcgacggctcagccagcaccttccgcgtcatgttcaaggagccggtggaggtgctgcccaacgtcaactacacggcctgtgccacgctcaagggcccagactcccactacggcaccaaaggcctgcgcaaggtgacacacgagtcgcccaccacgggcgccaagacctgcttcaccttttgctacgcggccgggaacaacaatggcacatccgtggaggacggccagatccccgaggtcatcttctacacctaggctgcccgacaccgacaccgccctccctccgtggggatagccgcagccccaggccatcatctgctgctggggcccccccaccacgcggtgccaggcccagtgtcccccaggccgtctgtccactccatgccacctttctcagcatcaggacggggttgccctgtgttcaccacgagtgtggctgctggatcagggcagccggggaggtggccaggccagtggccaggccctgtggggacaatccctcaggactagggacagggctgtgccggcctgggccagggcccacggacccgcagctcagggcgcctgcccacgtcgtctgccggcggtgcgccgcgggcgtccctcgcgtctcttcactgcacattgcaatgcatttgcgattcccatttctctgctaggagccagcctgggtggcgctgctcccagagccgtgggtcccagaccttgcgttccttttgttcctgtccgtttatcaggacacgggccccacctgtcacgtgcccgaggccacccaagcccagcctgcggggcgttcccactgcctggatgccggcttgagttctgcgcacgcaggattcagtgtggggacggcccctgccggataggcctagccctggcccaggtggtgagcggtttgcagtgtccgttctcatccacctgatgggcccagataaaggcccccgctgtccagcctccctggacggccctcgcggtccctgcagcccaagatgggactcagaccctgtgccccagagctcccctgccgcagaatggggccccagccggccccgaccgggtccaggagcactgctcgcctgtacatactgttgccctagcccacctggtgccgtgggagccacccccaggtgctgggggcacagcccctccccactccggccacgcccccacccaccccgcgtgtttctgccctgtgactcctggaacctgcgtcctccccaaagccatgggaggggtgtcctcctcagaccatgcccccagatgatttttttaaataaagaaacaaatgcacctgc

SEQ ID NO: 1154 - DNA, 2169 bp, Homo sapiens
atgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggaggtaggagtgggcgggcgacctccaggactgagaggcagcacaggccagggcctccgagaagccggtacggcgcggctccttcagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaact

SEQ ID NO: 1155 - DNA, 2718 bp, Homo sapiens
attttcctggtctggagcgaccaatgccgtcctccttcctccaggcacctgttcaccgaagttgaggctggtcacaactccggcggcccaaggagctgctcggttcacccacaaggaatgagagctgcctgcctgctgctgcttggagagccccagacagtcgcttgaagaggtgtgtggatgtctcctagatcttgacttgctcctgaggaaatattgtgtgactgagtttcctgttatactgctctccaatccatcatgaaccagccagagtctgccaacgatcctgaacccctgtgtgcagtgtgtggccaagcccactccttggaggaaaaccacttctacagctatccagaggaagtggatgatgacctcatctgccacatctgcctgcaggctttgctggaccccctggacactccgtgtggacacacctactgcaccctctgcctcaccaacttcctggtggagaaggacttctgtcccatggaccgcaagcctctggttctgcagcactgcaagaagtccagcatcctggtcaacaaactcctcaacaagctactggtgacctgcccattcagggagcactgcacccaggtgttgcagcgctgtgacctcgagcatcactttcaaaccagctgtaaaggtgcctcccactacggcctgaccaaagataggaagaggcgctcacaagatggctgtccagacggctgtgcgagcctcacagccacggctccctccccagaggtttctgcagctgccaccatctccttaatgacagacgagcctggcctagacaaccctgcctacgtgtcctcggcagaggacgggcagccagcaatcagcccagtggactctggccggagcaaccgaactagggcacggccctttgagagatccactattagaagcagatcatttaaaaaaataaatcgagctttgagtgttcttcgaaggacaaagagcgggagtgcagttgccaaccatgccgaccagggcagggaaaattctgaaaacaccactgcccctgaagtctttccaaggttgtaccacctgattccagatggtgaaattaccagcatcaagatcaatcgagtagatcccagtgaaagcctctctattaggctggtgggaggtagcgaaaccccactggtccatatcattatccaacacatttatcgtgatggggtgatcgccagagacggccggctactgccaagagacatcattctaaaggtcaacgggatggacatcagcaatgtccctcacaactacgctgtgcgtctcctgcggcagccctgccaggtgctgtggctgactgtgatgcgtgaacagaagttccgcagcaggaacactggacaggccccggatgcctacagaccccgagatgacagctttcatgtgattctcaacaaaagtagccccgaggagcagcttggaataaaactggtgcgcaaggtggatgagcctggggttttcatcttcaatgcgctggatggcggtgtggcatatcgacatggtcagcttgaggagaatgaccgtgtgttagccatcaatggacatgatcttcgatatggcagcccagaaagtgcggctcatctgattcaggccagtgaaagacgtgttcacctcgtcgtgtcccgccaggttcggcagcggagccctgacatctttcaggaagccggctggaacagcaatggcagctggtccccagggccaggggagaggagcaacactcccaagcccctccatcctacaattacttgtcatgagaaggtggtaaatatccaaaaagaccccggtgaatctctcggcatgaccgtcgcagggggagcatcacatagagaatgggatttgcctatctatgtcatcagtgttgagcccggaggagtcataagcagagatggaagaataaaaacaggtgacattttgttgaatgtggatggggtcgaactgacagaggtcagccggagtgaggcagtggcattattgaaaagaacatcatcctcgatagtactcaaagctttggaagtcaaagagtatgagccccaggaagactgcagcagcccagcagccctggactccaaccacaacatggccccacccagtgactggtccccatcctgggtcatgtggctggaattaccacggtgcttgtataactgtaaagatattgtattacgaagaaacacagctggaagtctgggcttctgcattgtaggaggttatgaagaatacaatggaaacaaaccttttttcatcaaatccattgttgaaggaacaccagcatacaatgatggaagaattagatgtggtgatattcttcttgctgtcaatggtagaagtacatcaggaatgatacatgcttgcttggcaagactgctgaaagaacttaaaggaagaattactctaactattgtttcttggcctggcacttttttatagaatcaatgatgggtcagaggaaaacagaaaaatcacaaataggctaagaagttgaaacactatatttatcttgtcagtttttatatttaaagaaagaatacattgtaaaaatgtcaggaaaagtatgatcatctaatgaaagccagttacacctcagaaaatatgattccaaaaaaattaaaactactagttttttttcagtgtggaggatttctcattactctacaacattgtttatattttttctattcaataaaaagccctaaaacaact

SEQ ID NO: 1156 - DNA, 2170 bp, Homo sapiens
gtgtttcttggggtggaggggctgaggagggcctacctccctctccaaccccagccatggcccctcttccttcctcacccctatccgttttgactgtaagtccagctcacctttgccttcaatatgtaaccaaaggaaaactcaataccgtttccaccactgtctgcccacccgagcaccttcttactccctggacctagaaggggagaagaggctggaggtggggtggatggggccagagtgaacggttctacagctgtatccccagaacctcctccagggtcttggaaggagtcctgagaggtgggattggggccgggctggcagggctgagtttgcgcactgtgtatcttatgcacatgagtgtttttgtctaaatgactccagtgactgctccagcggggaggccccttcctccttccctctcagccatttctcacccacttcccatacccagtgttcatcccctacctccccttcccaccgcaaaggaaaatagccttacagaccctagcccagaaaccctactcctggggcaaaccagtatgggcccccatcccgcctagtttgaaccctaccttttaagaaggagggataaggaacaaagcagccccttcccctctaattgtggtggctccagccttctgcagccttgacccaggttgggcaagggcggaggtgaggaatctttgaggaccaagcccagtggtctgggaatcgggaggtagagagggaagggtctgccttgggggctccctcctcccaacccaacccctagagaagcgaccaaatcccagagatggggtgaagctggggtggggagggtctgctctttgaattacttgaaggtactgactccaaggctgctgttgcccacttaggtgtgagggggacactgtcactgcatttgggagggcagagggtggcgggtaaccagaggatccaccttggccctcacccactcctgctaggccctttccctggggaatctggaagcctgactttgcccccagggaagttggggaccgccttccctcccttctccacctctcactctgggcaccctctccaattgcactaaagtagctgttgtgccagtctgccccccacaaggggggaggtctctgcttccagtcttcttcccccgctgcctccgctcccaccctggacaatctccttgtttcccttgtgttcctggatagctcagctttgtatgtgtgtttggggggtgggggtgggttctggcttgagtgggtttggcaggggtttgggaagggttaggggaggatggaggatgaagtctcctacccccttccccagctccaggccacagaagcctgggaagggagggtgcctactctcgctgctgtgtgtcttgcagatgtgccaaaatgggggtgggtgggaggggagggtgcctggcagagcagcccctggggtggctctctcaaagcaatatagttcccctgcgggggacagcaagacaggggagagggttggggtggggacctgggggttccccatgtacagctatgtatattcaggggtgttctccgtctggtacccgctgtgggcatctatgtgtgtgtgaacctccccttccccatgccctgcatgacctgtgatgctgcagacaccaccatcctgtgtgcaggtgtgtgttggggggcacggaggggcatgttccatgtcctgttgcaccctccaccctgtgacccatgtactcggttgtaggaagtaaagagaactgagcacaattcactggattctagtggaatctttctctaagcaattttcccattcctgcctctccctgccccggaaccacctgtggtgctagtgttgggatcgggggcgtttaacgctggtgggcagcaataaggggcagatgtgcccagatgcctgcatccccagggtgccgagggcagcaggaaaaagtggggacctcggtgcatttgccccacccctcccctccctgggctaaagcacaatgttctccccgcagattaatgaccctgcaccctccaggcccctactcacatcctcccccaaccggcttcgggtcctcccaccacactctggttttctatgctgttttggtgcaagtacaactgtcgtagtcatggctttgggatgggttctgtttattaaaatcctattgctcctactg

SEQ ID NO: 1157 - DNA, 2649 bp, Homo sapiens
agaaagctgcggcgcgagtccgcggggccgacctcggagacgcagctggggccgggcgcggcttggcgggaaggtctgcagcgccgagggaggctgctagtgcgtgaggaagagagctagagactggacacgggagacagagcagcgtcagagccgcgcaggggacgggagtgagagcaggagcgacgcagagcggccgtcgccgtgcccgggtctcagggcgcctggctgaagtgagcatggcttcagtggcctgggccgtcctcaaggtgctgctgcttctccccactcagacttggagccccgtgggagcaggaaatccacctgactgtgatgccccactggcctctgccttgcctaggtcatccttcagcagctcctcagagctgtccagcagccacggcccggggttttcaaggcttaatcgaagagatggagctggtggctggactccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgaggtggaaccccactgagctggtgggttggaagaaccaatgaaacacacacctactggggagtttctctgcctgatgctcaaaagtgtacttgtggattagaggggaactgcattgattctcagtattactgcaactgtgatgctggccggaatgaatggtgatttccacatgatttccctgcacaaaaatgtggtttttattctttaattatgcatagttaattaaatgtcagacaagctggtacaataaggtaactaaagtatgttcaagcaagctgaaatacaagttttgatgaaatatgatcagttaatctaaggattaaattttatgacc

SEQ ID NO: 1158 - DNA, 2841 bp, Homo sapiens
ccactaaatgcgtcggagcatctccgcgcccaggcggctcctcctcactgcggcaacccgggaaaacttgtgaactaatcagaaaaagtggaaggcgggagatcttggggcgctgcccaatggcgcggaagagaacacatgagctggccaatcgggaacggcacgggggcgggctcgctcggcgcgaagttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcgggtagatccgaaacggggctggggcggagtgggaaaaggccgggtatgccttgcatgatcgcggggagctccttcctgtttttatcccacctagagaagccgggaagtaggggtttaggtccaatttgttggagtacttaaggactcgtttgcactttcttttgggggatgacagtggattcattgccctcggaggttcaaccagttatgagtgagggattggccagaagatcggggcgcaggcaagcaggagtgctctattaggataagcaagtttgacaggaagaagctactcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgcgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccaccccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtgagcattaagcagggcagctttgcccctgggtggttgaagcgccaggctggaatgagtaaggtctccacaagaccctgctgcctgcctcccatactcccatcagattggatggatggtcgtggtccagaccttcatcttcccaccagaagtgtgcacagtcagaagctctctgccagactgaccctttttggtcccgtttagctcatacaggacctgggatatcatcagaaagatatcacagtggggatgttctgaggccactagaggccaagtttagacttgattcagtttccagctttgctgaggcactctgttcctgggttagggcagttctatgttgaataatgtttttaataatctgggcatgtctttctccgtgacttgaggcagttagcctcagaaagcctagattcacatttgagttttgccactgcctcttggtaaagtcagctgtaggagtgttatggttattagactatagtagccaacattcatctagtgcttactgttatgagccaggccctattttaagtgtattgaatgtaggtggtactaatattatcctcatttacagtaaaggaaaatgaggcacaaagaggttaaggaacttgtccagggctgggcatggtggtttacacctataatccagcactttgggaggctaaggcagggtggatcacttgagctcaggagttcgagaccagcctgggcaacatggtgaaaacctgtctctaccaaaaaattaattaatttttttaaaaaagcctgggcgcggtggctcacgcccgtaatcccagcactttgggaggccgagatgggcagatcacgaggtcaggagttcaagaccatcctgaccaacatgttgaaaccccatctgtgctgaaaaaaaatacaaaaattagccaggtgtggtggcgtgcacttgtaaccccagctactcaggaggctgaagcagcagaatcacttgaacccgggaggcggaggttgcagtgagctgagatcgcaccactgcactccagcttgggcgacagagcgagactccatctcaaacaaacaaacaaaccaaaagcttgcccagggtcacataactggtaagtggtagagctaggatctgaacgagctggagctgggggagagtgagcatgtttgaaaactggaccttagggcggggcacggtggctcacacctgtaatcccagcactttgggaggctgaggcgggcagatcaggaggtcaggagtatgagaccagcctggccaacatggtaaaaccctgtctctgctaaaaataaaaaaattagccagacgtggtggcatatgcctgtaatcccagctactcaggaggctgaggcaggagaattgcttgaacctgggaggcggagtgcagtgagctgagattgcactactgcactccagcttgggcaatagagcaaaactccatctcaaaaaaaaaaaaaaaagaaagaaag

SEQ ID NO: 1159 - DNA, 2559 bp, Homo sapiens
tttgattcaaagccagtttctcttttctgcataggaaggtccttgaaggtgtttaggtctaaaaagggtggtgttcggtctctgaaacatccattcagcagtttgagctgggatctctgaatgcaggggtatgatggatatacttctttcttgcttttgttgtgttttggttttttgtttgtttttgagtcagggtctctctgtcaccaggctgtattgcagtggtgcaatcatggctcactgcagcctcgacctcccaggctcaagccatctttccacctcggcctgccagtggctaggactgcgggcgtgcaccactgtgcccggctaatttgtgtgtatatattttgtggagatggggtttcaccatgttgtccaggctggtcacgaactcctgggctcaagccatctgcccgcctcatcctcccaaagtgctgggattataggcctgagcccaccgtgcctggcctttcctgtttatctttgaaaattaaatagggcataagagagaagaagatgtacttacaatgcagtgggtggttttaactctatagcctttgggctctgtggttggtgctccccttcctaaataaattaggtgtatgcagggccctcttctgccttagcgccctgccagctgggactccagcaaggcccggggcacctgaggacagagtgagatggagggccgctgctccagcagccgggcctgcatcccacaagtcaactgtgtcggacagaggatccttacaaagaagaggcagcagggttgggggctggccagctgctcgtccgccctaggtagcttgctcatctgtaaagtgggtggggcaggagttcccacctcatggggacctggcaagcctgcagtatccccgagtggcaccagcctgcttctggggcagagcagtttgtgccccctgaggtaccactgatcctctttccctgctattaggtattgctctcttcctccggtgtttgccttttcagattatagaagtaatatgtgttcccatatttggcgtctctcaggagctcaggaagtacttggctgagtgaacatgtccattgtggaaaaatggcaacaatatggattccatgggtatattttatagaagaatatgaagaaaagcagctacccctaaacccattgcacaagctgttcatgttaattctgtacccgacgctttccccacggggcctcccctcactctgaaatggcatccaggtccatcttgccctccacctctgcatggttctccatgccccatcgcctctcccagatcctagcactgggtccacactctcgccctgtccatttaggttgatgaaagcaggcagtcacccgggtgggccagtcttgcctgtgggaggaacatgcagtctcctgtctcatggtttgaagtgtgccaggaagcctggcccagcccacctccccctggagtccttcccaggaggaataaccccttaggtcattgactataagatgagttcgctcactggatccttcctctctgatgagacaggaagaaggtacacagtgaccaggtaggaggaggagagggagtagaaaggagggatgcgggtggctggtccctgcatttgcctgcttccctgcacgggtgtcccactggccgcctctgctcaccagtgtcatgggattctctcagaagatgaaaacagcccctgcttttttgctagaatggctgagctttcatggaaaggaagctggacccaagcaacagccgactaccgaaggttgcctggagcagtgcagatgtgggaggaagaagggccttggtgcacactggcttttcttcctgactgcaatgtggcattgtgccagctacctcctctttctcggcctcaggaaaatggagagaaagcagccctgaaggtggctgtgacgagggaaggggcagagggcctgacagtcaaccacgcgctatattttcctgttcttccttagggcaagaactgcatggccagactcaggcaaggcctaggtgtgggctgggcattgcctacacgtgaagagatcactccgcgtccctactgcacctgtcacaaagtgccttctgatatgcctggcaaaccaaaatcggtgagcgccagcttgcttccctagaagacatttctaaatattcataacatgcttgctcaaatcaatcaccttattttacatccgctccagggagaaatgaagacatggtcctacgttgttctgtaattattttctatgtaaattttgttccttgttacaattatatatgtcttaggggaaaggaccatttcacatgtgtcacctcatgtgattctcaccacagccctgtgattgctcctgttttataaataatgacatagttccagttgatggccaaagccacagctaacgagaggcagagagagctcaggctcccaggagcttccactctcagaccttgcctcccgggctgccctgagtgaaacccctgcttagcatttggcacagccagaagcagcaagctagggtcacaacacagagaggggctgtgtaatactggctgcctctgtgctaag

SEQ ID NO: 1160 - DNA, 2315 bp, Homo sapiens
cttttccaagcggctgccgaagatggcggaggtgcaggtcctggtgcttgatggtcgaggccatctcctgggccgcctggcggccatcgtggctaaacaggtactgctgggtaagtcgctgctcgtggcccctctgtcatgggcccccgctggaggtcagtgatgagcaacattcaccatctttcgtttgagtctcacggccatgagatcaaccccatgcaccgctctgagacctgccagccactcttccccagggttggggactccaggctcaagaagtaattatgtattaggctagtttttcatttaaacaggaacttagctctggcaagtactgcgctgtgtctggagggtgactgcataggcagtggtgggaccctcaggcggctcggccctgctaagcctttccctccctctaggccggaaggtggtggtcgtacgctgtgaaggcatcaacatttctggcaatttctacagaaacaagtgtaagttaggacctgggaggagcactggagagggtctccctgtggggtgttgaggctctgaaagcaattgcagccgtgttgggagaggctacttggggtttctgagaaggcccttggaagtggggttttgggggtgctggtagactgggcaggcctcacactctcccctctccctagtgaagtacctggctttcctccgcaagcggatgaacaccaacccttcccgaggcccctaccacttccgggcccccagccgcatcttctggcggaccgtgcgaggtgagcagagcgtggggactgcaggtggtgacgggcaggcggccggtgatgagaacttctcccactcacattcgagtttcccgaccatgagatgactccacatgcactaccatctgaggccaccccatgggcccacctcagtggggtgggtgggcatccttatgaggccctctgactgggcctgctatctgtcacccaacaggtatgctgccccacaaaaccaagcgaggccaggccgctctggaccgtctcaaggtgtttgacggcatcccaccgccctacgacaaggtgagctatgccaaaccccacaggcagcggccttacctgtggcgtccatgatgttccgcaactacctacattgtttgatcctcatgaaagcagcactggctgagacgccagtccagccgacctccttccctgtctgtccctcccgggctcttaagcccctctctttctctaacagaaaaagcggatggtggttcctgctgccctcaaggtcgtgcgtctgaagcctacaagaaaggtgagtcccagcttacgctgcaccatctacttgggagatttcaggcctgctgagggacctggggacctggagcctggcagatgatgtccttatctcacgatggtctgcggatgtccctgtgggaatggcgacaatgccaatggcttagctgatgccaggaggcttgggtgggtgcttttctaacaggcctgcagagaacagttgcattatgatatgcccagctgtcagtcacctcccagctctcaacagctccggctcttcagggtgtgggggcttagatatccttacaacttcatttgttcacccccccccccccccccccccgcagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaag

SEQ ID NO: 1161 - DNA, 2212 bp, Homo sapiens
gttgccctcaggtcgctcccgggcgcggacacggaacccggccatggaagatccgtcgggggctcgcgagccccgggcccggccgagagagcgggacccgggacggcgcccccacccagaccaaggccgcacccacgatcgaccgcgggaccgacccggggacccgcgcaggaagcgaagcagcgacgggaaccggcgaagggacggggaccgggacccgaagagagaccaggagagggacgggaaccgcgaccggaaccgggaccgggagagggagagagagagggaaagagacccggaccgaggcccccgccgggacacacacagggacgcgggccctcgcgcaggtgaacacggagtttgggaaaaaccgcgccaaagccggacgcgggacggagcccggggactgacctgggacgcagccgcgcctcctgggcccgcgccctgggaagccccggagccgccgcagccgcagaggaagggagaccccgggcgccgcagacccgaaagtgaacccccttcggagagatatctgccctcgacccccaggcctggacgagaggaggtggaatattaccagtcagaggcggaaggactcctggaatgccacaaatgcaaatacttgtgcactgggagaggtgtggtgcagatagtggaggtggtcttgaatgggatggttctcatatgcatcgtggcctcctactttgtccttgccggattcagtgccagcttttccagcggcggtggctttgggaacaactactactcaccgttcgagggcactgagctagagcaggttcggcagctggaccagcagtacacgatcctccgctcgcccctgatatacggtggcgtggctgtttctctgggtctgggggtcctcaccatgggtgttttactccaaggagccaagagtcgaacaatgttgtcagggaagtggctcctcacggaggccgccttcagcctcctagcggcagtgggctactgcacaggcattggtgtttacctccacgtggctctgcagatcaatagcaccgacacttgcaaaacaagagagaggctctatgcccgcaagggtctcacctggatggactgccagctggcaggcaccgacggagcagcagccacctttgcttgtcttctcgtgatcatgtacggcgccagcgtggtgctggccctgcgtagctaccgagaacagaagcgccacaaaggcagccgagaacagccgggaagttacagtgatgcaccggaatatctgtggtctggaactctttgagatcttccggaacctaaatgtgaacgcacattgtttctctcaaaaagacaggtcttttaaaactccgcattagacaactatggttttcacacacttgactttataaatgctctctttggactgaggcaaagttaaagaattgaggacgggcatggtggctcatgcctgtaatcccagcactttgggaggctgaggtgggcggatcacttgaggtcagcagattgagtccagcctggctcacatagcgaaaccctgtctctactaaaaatacaaaaaatcgccgggcatggtggttcacgactgtaatcccagcactttaggaggccaaggcaggcagatcacctgaggtcaggtgtttgaaaccagtctggcaaacatggtgaaaccccatctctactaaaaatacaaaaattagctgggcgtggtggcaggcacctgtaattccagctactctggaggctgaggcaggagaatctcttaaacccgggaggcagaggttgcagtgagccgagaccattgcactccagcctgggcaacaagagcgagactccgtctcaaaaaaatacaaaaaatcatctgggcttggtggtgaacgcctgtaatcccagttactcaggaggctaaaccacaagaatcacttgaacctgggaggcagaggttgcagtgagcaaactccactccacgtcactgcactccagcctgggtaacagagcgaggctctgtctcaaaaacaacaactacaacaaaaaagataggacagtagattttattagaccctgaagcatactggaggctttttcatttctgcattccctgacagtgctccatagagtaggtcttcaaaggtagatagtaatctcattaccctggactgttctcataatgtaacagatcactaacactgaatcttaaaaataaagttcttttagtaatttt

SEQ ID NO: 1162 - DNA, 2912 bp, Homo sapiens
atcgagttttccctgatcaagtaagacagaccctaagctggagccaagtggctgcttctggactgcgctctgtcttccgtgagaaactgcaagaccccgagccaccgagagggagacctaacaggagccccgagaagggccccctgcgtcgctggcacctgcctggcacagagcccttgctgtctgtttgatgaggatcacttgtcctgcagccagagacagtggggtttgggtccagccctgccacctcctggcaacctcatttgtgagagccgttgagggggagaatgtggagattcctgcgggatgctcccggccatgtctacaggaagtgcttactgttcaatggcatgctttgttttggatagaatcggactccctccccagcagagagcgggaggcaggcattgtgatccctgtgtactacagaagctggtgttctaaagatgccctgcgtggcatggactcatattctggagccaaacagacttctggggggatggtgtctccgtttccccaaccccaggggcccagctgggaggagacagcaggcaagggtgtcccctgctgatctttccacaagacctgcactcagtccccacatcaatgggcactgcccacccagacagcacctactcctgtgggcagcacccagaaccggtgctcacgatggggaagtcaggactgtggagaagcgggaaactggagcccgagggcagggtgctcaggagagacccatccagacagcaatgctcaaggccaagtgagaccaacgacctggaatccagggagaaagcagtgccagtcctgtttctctgggcctcatcctctcctccatcaaaatgaggaaccgtggactgcaggagcattgaggaagccacgtggagtccccgctctgtgttgagccccgtagggtgcccttcctgtgggcggccattctgggcgtggcgccccctgtctgaaatcagcagcacaccagctccctgtgctccgtgtgacaagctgccagggacaaagagagactcccctgggaccacagcagtaggcacggcattcctgtgacagaaatcaatgccacagatcgagggatggagccaccggctccccaggttgagtccccttccggtaacacggccacactccttcctccctccaagaagatcccagggagggcgatcccgcctggatgcgttcctcactccctttcaggtggccccagacgctgggcattgggaggtggccacgtggggacatggacatgaaggctgggtaagtgtggggaccaggcgagctggctgctggacacccacccaccctgtgagctgcaccagaccctactctctgtgctctggaccccaggaagcagtcaggattgggggggtcccactcacaggccccggcgccttccacctgggcagctgccatgtgcaccctcaggcttcagactcctggccacgggggcggtggtgtggaccccaggccgtgtgtgcagatgcagcaaggtgacatcagccatacattcactgcgtcactcctcacccagctccttctcagagcctcactcggaacagcacatctcccatctcagctgccctggccacttctgtgtaggaggcaggagggatactcccaccaccccgacccttacagataacaggctcagaaaggcacctgaccccacagcccttcagttgggtttgaacctgggttgcttggtttcaaagcacaggggtttgtcctgcccagtcacacccctcaaagtgtggatgtgggaaacaccgctgaggagcctggacatccaggagggctcaggagacccttcctgactgcaccccggacaggcccacgacaggcagatgggacacaggtcaggatgtggcaggcacacggcctggcttctagacacttctcagacctgggagaggagagagggacaggtggtgtgggcgtgctggaggcgggaaggggataagagtgttggttatcacgggcaatgtggacacacggccaggacaggggtccacagtatttcaggaacctcccacaagacgaaacttctagacagacttccctccctgtgagataccttaggctgtagtggagaggtcgctgaaagaatcgatatttctagaaattagctttgggatcagtttgcgaagctgcatctatgctgacaagtgaatgaagcccgtgggcagggaatacactgaggccttaggcctgcagaagagcacaggtgcacctgcgccacatgggccagaatcaacccaggtgaattccagcccatgccattgatgccaaccatggacgaggaatccagctggggctgaagttccgctatgctgtcagttccactggggatgtgtgttgctccttcagcctctgccagacacacaggcccggttccagcacccgggtgtttgaggccagtgtgtgagtcagcccgggagcctcagcctttcccactggcttcaaaaagatgtggaggctgatggggaggaggaaggttccccagagcaggaggccatctgatgtaatgaacatgccttcctaagacgctgcctgggccgcagccaagtgtggtcgctctctgagcaatcgatgctgccacaaaaggtcctggcagcagcggcacgacccctgcaccccgcctgctgcatccaggacagcgctggcctcccacggcggctcccgggagaagaggagacgccactttggctgctgtcccggggagaggggggacagtccttcgacttcatgcaggggcttgtcaaccccaaagcttcctccgccgccatctgggtctgacgctctccgctggaaggtgttcaggagctggcaccccacgtccaccagcgctggcttcaaatcaaacaataaacagcatttaaaaaaaattagtcccacaggtc

SEQ ID NO: 1163 - DNA, 2122 bp, Homo sapiens
agaagatgcagggcgccaggtgcgagggttcacgcctgtaatctcagcactttgggatgtcgaggcaggtggatcacgaggtcaggagttcaagaccagcctgaccagcatggtgaaaccctgtctctactaaaaatacaaaaaaattagccaggcgtggtggtgcgtgcccatggtcccagctactcgggaggctgaggcgggagaatcgcttgggcccagggggcggaggttgcagtgagccgagatcacgccactgcactccagcctggtgacagagcgagactccatctcaaaaaaaaaaaaggcaagcttgacctggccacttccttgctgggcagcctctgccttaggagcctcagtgccctctcagtgaccacagccagctgctggcctcccactggggttcccccgcacacctgaaccgtcactgggtttaagacaccctgtggtcgttacggttcctagtgcctgtgagtaaaccctcatttatggactatgtgaattgcagagtgcatttcccagcagggctccaggcactgagaaatgaaggaatgcctcctccagggtaaatgttaccactattatagctctgggtttaccgagtgctgtcacgtgcaggtgccacgcaatgtgccctctgtgcattacctcatttaccccacggaactgtcctgcatggaaagcatgctcagtgtcctcatttacaaaggaagggaccctgaccaggcgcggtggctcaggcctgtaatcccagcactttgggaggacccgtgctcccggctgcagttacagcgtgaacacaggcctggcattagcccactgtgctgtcagcagggcatgaccggcgcttccatccgtctgcagagtgggagtcaaggagcagcagggggttaacggggcacgccaaggtgggctgtgcacacccaggagctctactgctgttttgagcccctggaagattttgcacagggagtggaacaagacgctttgagtctggaggcagcgcagcatgcgggtgccatgtggctttgtgggccacgtagttccttcatgctacagcactccgcttcctattttgtaaaaagcaattatcaacaacaacctctacttgtcaggaaggattcaatgaggtgacagctatgaagcgctccagacaagacagtacctaggactgtgtgtgtgttttttttttaacatcattcagtcattctgaatattttttatatttttagctcaggcacagggctagaaattggaaatttcatggtggcagatgagatggaaggggctgaggccagttaggaggcaatgcctttaccattgtacaagaagaccggggcttgtttgggagactggaccagaagcctgggaggaggatgcatcattaggctggactgatgggggctcagtgtctggggttacggttggggtcaggaaagaagaatggccaaagtgagcttcatgttcgggtggccgagggaatgatgatgccatcagcccagccatcttgcccactggtggcgcatcgccaagccccaccactaacgccagctttttctctgtccccagagtctgcccaggaacctgccagtaaccatcatctctcaggactttggggatgccagccccaggaccaatggtcaagaagctgatgattcttccacctcggaggagtcacctgaagacagcaagtacttcctgccctaccatccgccccagcgcaggatgaacctgaagggcatccaggtgcatgggtgtggagggagggggcgcaggtgcagggcagagggtctgtgagccgggggcccctgcaggcggcgatggggcagcacagccacgcctgcttctgggtgggtcttgggtgcccagactgtgactcaccctatttcaaccctgtaagctggaaatcctgcgactcgcttcttactcatttgtacatttttactgatttcctcactcttataaatgtaatagacattaaaagagagagaaagaaagacaggctgggcatggtagctcacgcctgtaaccccagcactttgggaggccaatgcgggaggatcacttggggtcaggagttccagaccagcctgggcaacataggaagatcaagtgtctc

SEQ ID NO: 1164 - DNA, 2642 bp, Homo sapiens
atatatagcatctgggacccagtttggggtaagatacactctaaggaaatatgtcttttgactgcagtgtcaatagtgaagcaatttcagccttccagataaatatttttttccagaaccggtattcatttcagaaagtttgccctaccttttgtaggtcagattatccacagctgcccaataaatactttccctactaggaacaatgatactacatttgggagaaagaaaattgtccggcacttaagagaccacaagatgcctcttagtctactagtggatgtgtggagtacaagaagttccacctggtgccactagggtgggtcgctcgtgcaggatggtttatcaggaagtctctcaagcagcaatttctcctcgtcagcgcaccatgctcatttcacagagtgtaagctgatgttcctgatgatcacacttcagcattttcaggtctgatgtgacttctgaatccaggaaaaaggcagactcagcatggtgtgactaagcgtgacctgctgtaggtgttcagtactcaaggcttattaaatcctagtgtgtgactgtctgttaagcagggcttgcttgtaaacagttgatactcagttcataggaataagtatctgtaggctttaatttgatgacataaatctcagagggcttgcttggttttgagtttcaaataacaatttaaatgtcaccactaacatgtgagtgtctttgtaactcttgggacagtggaggtgaatttcaacatagctgttgtgtgatggaggaaaaactggtcctctctgtggtgtggtgcacctctttcacctggcttccatcctgagctaaaacatcctaggtctcccaactggtgacccttggagtgaggtttgtcaaacagcagagcggtgtgactcaggagtccattttataaatgccttttaactataacatcactctaaacattcaggattttgacctcaaggtgtgaaccccaaacattttctcttaaaaactctcctaaggcctatttaaatgcaggtggttttatcgtttcctcctctctcctcttaggtattttaatgagatgtctgcacaaggattaagacctcgcactgtgtccagcccgatcccttacacaccttctccgagttcaagcaggcctatatcacctggtctatcatatgcaagtcacacggttggtttcacgccaccaacttcactgactagagctggaatgtcttattacaattccccgggtcttcacgtgcagcacatgggaacatcccatggtatcacaaggccttcaccacggagaagcaacagtcctgacaaattcaaacggcccacgccgcctccatctcccaacacacagaccccagtccagccacctccacctccacctccgccacccatgcagcccacggtcccctcagcagccacctcgcagcctactccttcgcaacattcggcgcacacctcctcccagccttaatgcatgagcttagtctgaatttcaagttgggactcatccaatggagccgtctactcaacgccaaaggcttccttctctggcatatttggatatgacttatttgcactgaggttatctaggcttcactatccattgtgttgtaaatgtttgtcagaaatgcagccagtgttgtgggtctacaacactaaccagacgactttttccatcagtgttttacttgaatcttcatgtacgtccattccctggctggaaccttcgctgtttggtatttggtatttcagcagcagtgtgcaatttttgcttggcccagagcttcattctcctggcttttaggtttgtaaaagaaaaagggatatcttttttatatttttttccatgaatctgcagaaaattactgagctgttgttaccctcctctcattataatagtgtttaccaaacataccaataattcagcactacaattcagacctttgaaaatctggctttcagtgtagaacagaaagttagatgaatcagtgcccaagacatattttctgtttaacagaactttctacagatacattttttacaggttattttcattgtgttattgacatccatgtctctcgtaaaacagatggcccaaagtaatgaatcatgtggctgtaccttctccacataaatgggatggataattatcgtatattaagatgtgattctcttttttatccttaatgttaatctacttaacctggccccctctaacatgagtcgataaatgttgtcctactcaccggtggtttcaatggctaattagaatgtgttatttgatttctgctgcagaaggcagtgtgattgtaacaaaaacaatgcggcttccccctttcgtacttcatttgtgttctcttaaaatagagtttgaacaaatattttaaaggtgcaaaataccattagaaaatactatttgaaatggacattatcgcattatcttggcataatggccagaaaatattgtattgcttggcagaaaagaaaataaggtctaaaggaaagtagcacattagcattgatggctgttcatttcacccagtataagcaagtgcagtgtacaaagaagtatattctgaatacattatttccattcatttagcacaaataaatcatttggtttcactttgcagtgg

SEQ ID NO: 1165 - DNA, 2488 bp, Homo sapiens
acaccggcgtgctcgcaagaggcgggaaagcgttagggagagacgcgggtcgcagggtccctccctctgcctgccctatctacccgcctgcccagcgagcctgtccatcttcagcgcccaggccctaggggaggggacgagaaaggccccgcgcttctggctcatcatctccaacccctttctcgcgcgcgctccaagtctcaggacttcggacctgggccctcctgcgagggggtgcggcgacagcatctgggaagccccagctctgccaagcgtcagctccgagccctcgccagtctctgaagctgccagcgcagggctggggacccagatccagctctctattgcagtggctgggggagcggcacgccagtgcaggaccgcccgcccggctcctccccgagaaagcgccaggctaggccccgacttccccgcctcgcgtcactcagcacatccaacagcgcccctaccgcggagagaaggctctttatttcctagccggtcacgggctagcggggcatcctgggacttgtagtctccgctacagtagaaaggagatggatcgaaaggggaactggggcactcctgaattggattcagggagttggcgtgtgcagggtccgggatttggagtggatgggattatgaaaggtggacagaaaagaaaagtgcgatgaggcaaatgtgaagctgtatggggaggtgacaggaagagaggatatggatggaagggagaaagcagcttttcagggtggtgaggtgaggatatattctcgtccaggtgtatcttcccctaacagggaaggaacgaaaaaagggcctgctttgagtgaaaactgaaggcactcccggacttcctattggactcgaaggatcccagcaagcttctgagtttggtggggtgggatgcaggaatgtctggagagcattctctcagggtggaaggagagcagcacgtgtctgttcccgctgtcccaccctctcatttgctcctgtgctggccaccgtgggaccattctccaaaccaggaacctcttccaactcagagaagccctgaaaaccagagacaggtgtgagcaaattgtagaggtgagaaaggagaaaccccagacagaaacaactgcttcctcctgcccaattttatatcctgtttcccatagtcctgccaatatttaggcagcttcctaatgctttcccactcttttaacctcaatcatttggattcccaattccctcttacccaccattaggggagaaatgttcaaagccagagaaagccaatcagtttcattctaggacctcttcttttctctcctgccccattattttcccttaagtgccactgaccaggataggcagtggaaaaattagttggcagctagctattcgtgctttcttccctgcccccatacctcctgcagctcttgatagtgcagactctggctcctgcagcatcctggtttcctctggctcagcaagaatagggcgtgcactgagaccagcactccccctagggtgaaggcctcagcactgagttccagcaccagcaagccagcatgctgcaggtagacagggctgagaatgcagggaccccgcacctgtttgcccctgcccttttcccttcccacctcctcttgcctccttatcctcccaccttctccttcattgaccagtacctgggaggaggcagttggggcaggccccaaggctgtcttcatcacctcgaccaccaccacgatgaaacccaagatctagttgaaggtgttgaatatcaccatggcccgcacctgccagtgagccagctcagccctgcccagcctaggggagtcattccaacctcaatccccacttgcagcctagctgaagacaaaactcagcttctgcttctcagcctccaaacagggccataagccctcttaacttttttgctttcctcctcagtgattgaggccagtcagtggtgacagctgagagaatgagtcaacacttagccacttacttcctaggctgagggttgtaggcgtctgttttagggagtgggaggacagtgctgcgttttcttccctctcaccttccagaggcggggtgctctgcgaagctccagagtgacagtcccagtgaggagaccctgaatggtgagaagggcaagtgttgagctctggtcccgttaggaaggggccctgggaccttccaccctcccttgtggtgggtcttactgaggctccaggcccaagaggcagcgctgtggccatgtgacaatcagagttcaggcaggcgactgagacagcaaggggcaccacaaccactgccagccatagctggctcacctgggggtaagggtagggtaattggggaggaactgtcagggattccctcccttctcgtaactcctacctctttagagatcaggaaatgggattgaatgcagggtggaggaaagcagtcaacccagagcaaggacgtgatcattaaaaattaagtatcattt

SEQ ID NO: 1166 - DNA, 1909 bp, Homo sapiens
ttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatggcctgggttcctattctccagccccgccgggctgcggcccacactttgtttacagtcttatggtcaggctgagcagtgatgtggcctagcaggttacgggcaggacttgagtggcttcggacagggcttctcagaccccagccagcagcctccttcctacgggggtccctccgtgccagggtcggggggcccccctgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattag

SEQ ID NO: 1167 - DNA, 2187 bp, Homo sapiens
catcagcccagcctgcaaggaggcgccaccggacctgcacactcaggagcagactcagctagattggaagagaggatgggaagacaatggatgacctacctgtggagagaaactacccattccagaacctcctctctgctgaaagctgaacactcaatgggaagacctgtttgcagagaggagccagccactccagggtctccgttctgctagaagctgaacactcgttgggacacccttgctgtggaaaggacatccttactgtggaaatgagctactaactgcaggagctgaggagctgcacagcaaggttaaaagagctgtaacacaaacagggctgcaacatgccccttgctccccacagggagagaagagctctggccctcggagaagcccagacctgggagctccttgagcccgggctgtgactccctctttggggccctggttggcgtcactgcattcgccagtgccactgttggaagctgcttgtgatgcgcctggtccagggggaagctgtttgttgtgtgcctggtccagccacctcatggagagcctgtgctggcacctggagctgcccaacctgggcagcagcttgtgtgtgtgactgcacagtggccacgcttgctcacacacccctagcacacccctctgctccacccgtctcaatctcccttggatccgggatccaggttggtagcaagtgcgagtgggcagaagcagcccagtgggcccagagcaaaactcaggcaaaggtgccactagactggccaggaaagcgacaccctaaagatcccataatgctgatatgttaattctattctataagcaccacacagaagtgatagcttttatttcttattttgtctagcctggagacagagctaaggattccttgaactgcaaagtcttttccagttcttagtttatacaatccatactcaccttctgcctaactaagcattgtcatttttgtgccaaatgaagagtaggactcctacgattgtcctcagactctcttggctcaatcctcctgctttaacctttcctacttcaaaaactcctgaagttttgcttccccttctatagaatggaaatatatgtcgcaatacttactgcaaagaaaattatatattttaaaaatagactaaagagatgttgtgagacatcagacatcaatcagatgttgtgagaactgatttctgcatcagaatatctccttgactttacagctatcctttaatcctggctcaaagttccagaagaaagatgatccaatataatactcctatttggactttgagtcatacacattccttcttctgagaaaacgtgcttctgcatgaatcctcccttcattattttcagctcatctattattgaatctgaaaccccaggttaactgactgatcactctcatcagtggcagattttggtgtaacataggacacatcactcccaattcaggtcaagtcccaattatcttgcctctcaatatgacatgttcaatgttgtatttcattctacttcattttaatgtaaaaagtcttttctggtgaagtcagtcttttattttctcataaaaattcaccctttgggtttttcatagggtattcccataaccaaacacactttacactttcctagtacataacccaatactttcttctttccccacagtccttacatgaagcctactcagaccgacatcactgtatcatttttttgtattctgaagtccttcagcacttgattcctttaagtttaatcttggtattctattgggaatcatatggaaatgtacaatgatatttattgaatgaacaggaaacagggaaagacattgaccagaaaaagtgtttattcatcaagtctttaaagatacaaaaacacgtgtcttctgtggagctctgagaacaggactccagcaaagcacttttcagccttgtggtcttcaagcatttccaagatctgtgacattggaaagaaaaaaaattaagacagatttgggtctccatgagcagagagtattctttcccttagttctgggtagcatagtgcccaaggaaacctaatcagtacagtgggaaaccaaatctattccaaatcattacccataagcaatcctatggactctctgaggtttgacagagtcagcggccctctccaataaatgtgtttttctat

SEQ ID NO: 1168 - DNA, 2090 bp, Homo sapiens
gctgaactcttcctacccaggctctgaacacatccctgagctgcagagctgacgtctgggtgacagtgaaacggggtattcatttgtaccaaaacaaacaaacaaacaaacaaaacctggaatgacggtgtgtggatttcttgtgtgcttattcgtaggattgagaaagggtgaggctaaggtcccgagccttcgtgaagcaatggagaaagtgccgtcccaaggctcagttccacacggcgctgtgaggctgaaggggctcactggaagttcccctcacaggacgccacctcacctgaaaccctctttttctgctaccatccaagggacaagatctcctgagttgtcgaagactcactccggaagaaaaccctctcaggcagttactgagggactgtggtctggactagaacgtgtttttctcagtgacacctctagagggcagcactcaacggagtcccacagacacctccctgcatttcctcctcagacactgggtggatgatatggtaacactggggaatgcttgggtgttctcctggaagctccttattttaatcacctgtttacttgtctccattcttatagatatgtaggctacccgagggcagagactgagtctgtcttgttcactgtctacctccagaacctcacacagaatctggcacttagtaggtgcacaacaaaataatcattgaattagtatactgagtctttaacaggtgagtacgcagttccactttacattcactttctaatattatgcctttttatcctcttattgtataaatttctaacatgtataaaaataacacaaaagtataatgacctttcttgtattcctcatatagaatcaataattaccaatattagggaaaagagtgaaacgctgtaaaatatttgaagagatttattctgagccaaatgtgagtgaccaatggcctgtgatacagccctcaggagattctgggaacgtgtgcttaaggtggttgggatatagtttaattttagggagacatgagacatcaatcaaatatatagagatgtacatttgttcagtccagaaaggcaggacaactggaagtgtggacttccagattttgtgcagattataaaattttccaattggcagttgattgaaagagttatgatctaaagacctgggtgcagggaaaagaaagagagatcagactgttactgtgtctatgtagaaagggaagacataagagactccattttgaaaaagacctgtactttaaacaattgcttgctgagatgttgttaatttgtagctttgccccagacactttgacccaacctggagctcacaaaaacatgtgttgtatgaaatcaaggtttaagggatccagggctgtgcaggatgtgccttgttaacaaaatgtttacaagcagtatagttggtaaaagtcatcgccattctctagtctcaataaaccagaggcacaatgtactgtggaaagccgcagggacctctgcccttgaaagcggggtattgtccaaggtttctccccacgtgatagtctgaaatatggcctcgtgggatgagaaagacctgaccgtcccccagcccgacacccgtaaagggtctgtgctgaggtggatcagtaaaagaggaaagcctcttgcagttgagatagaggaaggccactgtctcctgcctgcccctgggaactgaatgtctccgtataaagcccgattgtacatttgttcaattctgagataggagaaaaaccgccctatggtgggaggcaagacatgtttgcagtaatgctgctttgttattctttactccactgagatgtttgggtggagagaaacataaatctggcttacgtgcacgtccagtcatagtaccttcccttgaacttaattatgacatagattcttttgctcacatgttttttgctgaccttctccttattatcaccctgctctcctgctacattccttttttgctgaaataatgaaaataataatcaataaaaactgagggaactcagaggccggtgccggtgcaggtccttggtgtgctgagtgccggtcccctgggcccactgtcgtttctctat

SEQ ID NO: 1169 - DNA, 2653 bp, Homo sapiens
aaagaaagattgtgacatatcacttaaaccagaacttaggtgatgagactcttctgtctagcaaccacttattttgggtattgtgacatttcactgggccaaacacctaaaaaatgggaggctcctgcctcagccctgtccacatatacctggacatgtatctgcatccattacataaaacatgtgataccttttctgcctgtaccctgcccacaggaaagattgtgacactgcagggcctggccgccagctgttgtgtctcacctgaatgtacataactttcaggagaaagttgtaacatgtcactggttgaaaacccagatgatgtgactctcctggcttttcacagccctcagggaaaaaatttacatatcagtggcccagcatccaggtgatgtgactctcctgggtgctttctgccaacaagttgattggtaacatatatctcatcccagctcacaggtttgatgatgactctaatacttcataccagtcaatagaagagatagtgtctctcacagctaggcttagaaaaaggagtaaaatctcaggtctcctctctgcatgaaggttatagcgaatcaccactctctcatatattgtataaagcactcagatgatacagagcatgtcatcataggacccagcaaacaggttaaatcatgtttcatgtaagcgctccctgacaatttttagaattgtcatcgtcacacatggtgaaagtccactgatgaggtcataattctcatgcacagatgcagtccacagttaaaattgtaactatcatatgtaaacgtggccacagttgagatggtgactcatttctaaacccagctcataggtgagtgaggactctcctctctggacccagccaattgaagagatgttgacccatacctagacttaggaccacataagatcatgggtccaaagcagcgcaaagttctcagagtaggttgcaactcatacagtcctcaagagagtgcccttacagggccaagcacacaggtgagattgtcaaacttacattcacacccagtcaatagcaaagattgtcatttacttaaacacaccctacttttgaggttctgaatctcacttttggaggcagttgaatgttggaaaattgactctcatttgtgtggattttgtccacatttgggtgactctttaatcaaaattcagcacacctttgtgactgtaacttcactaaggagctttatttatttagagatgaagtttcattcttgtaacccaggctggagtgcggtggcgtgatctccgctcactgcaacctctgcctactgggttcaagcgattctcctgcctgattctcccaagtagctgggattacaggtgctcactaccatgttggctaattttttgtatttttagtagagatggggctttaccatgttggtcaggctggtcttgaactcctgacctcaagtgatccgcccacctcggcctcccaaaatgctgagattacaggtgtgagccaccgtgcccagtctaaggcacacaatttgcaaaggaaattgaggctctcgcacaaatccagtccaccctgtacttacacccaacatgcaggaggtgttgactctcatcccttgactcaggacatgtgtgtaattgttaatgtcatcgcaaggccttttgacaagtgtaattgtgacatataccttggcctagcatctgagttatttgttgtttcctgggtccagctcacagtgccatatcactggatccagacccttggtaatgtgattctattctgccttgatacagcccacaggggtcattgtgacatcgctgggcattgcacctaggtgatttgagtctcctcttctgccttggtgctgcccacaggtgtattgtgacatattgctgggcgtatgttatgtgactcttgcttgtgccctaaacacataggccattgtaacattgctgagtgcaacacccaggtgatgtaacgcttcaccctggacctgtctacagagggcattgtaatatatgtcttcaccaatcacccaggaaatgtgactttttattcctccctgttctgtactcacagggggtattgggacatattgggcccagcacctagctgatgtgacttttctttattctaggttctgacaacaaaggagattgtgacatattgctgggcctaacactaaggtgatgttagttatttgctttggctgtgcccttggaaggcattgagacatactgctgtgcccagcaccaagatgatgtgagttccctgcctgaaccctgatcacaggaagcattgtgacctatctgttgacccactgcaatctctcctgtgggaaaagcacagataaatgccctcttttacctacgtgatttgacactcctctactgcctgggccgtgcccacagaatagagagtgacttatcactggaccaagcacaccagtgatgtaattattctgcttggtccttgcacacacaagtcactgtgatatatgtttgggcccatcacctagatgatgtgactcctcttctggggtccacagtgggaattgtgatacatcgcttgacgtagctcttatgtgatgtgacttttctttcatgcttgggcccttcctactgggatgattgtaacataaagctgagcccagcacct

SEQ ID NO: 1170 - DNA, 3471 bp, Homo sapiens
attgtattgcacacctctaaaaaaaacactgcctctgatttatcaatataaaaaagatcctctgagaggaggagggcacttttgtgtgatggcaacttcacttctaggggaagaaccgaggttgggatcgactcctctggccatgcttgccgctacctgtaataagataggcagccccagcccgtctccctcctccctctcggacagctcttcttccttcggcaaaggcttccacccctggaaacgctcctcgtcctcttcttccgccagctgcaacgtagtgggttccagtctctcaagcttcggcgtgtccggggcctccaggaacggcggctcgtcctcggcggctgcggcggccgcggcagcagccgcggctgccgcggccctggtgtccgactcgttcagctgcggcggctcctccgcgcactcgcaggacggctcccaccagccggtgttcatctccaaggtgcacacctctgtggacgggctgcagggcatctacccgcgggtgggcatggcgcacccgtacgagtcgtggtttaagccctcgcacccgggcctgggtgctgcgggcgaggtgggctcggccggcgcctccagctggtgggacgtgggggccggctggatcgacgtgcagaacccgaacagcgcggctgcgctgcccggctcgctgcaccctgccgccggggggctccaaacctcgctgcactcgccgctcggaggctacaactcggattactcgggcctgagtcactcggccttcagcagcggcgcctcctcgcacctgctcagccccgccgggcagcacctcatggacggcttcaagccagtgctacccggctcctacccggactcggccccgtcgccgctggccggcgcggggggctccatgttgagcgctgggccttcggcgccgctggggggctccccgcgctcctcagctcgccgctactccggccgcgccacctgcgactgccccaactgccaggaggcagagcggctgggccctgccggggcgagcttgcggcgcaagggcctgcacagctgccacatcccgggctgcggcaaggtgtacggcaagacttcgcacctcaaggcgcacctgcgctggcacacgggcgagcggcccttcgtgtgcaactggcttttctgcggcaagcgcttcacgcgctccgacgagctgcagcggcacctgcggacccacaccggcgagaagcgcttcgcctgtccagtttgcaacaagcgcttcatgcgcagcgaccacctcagcaagcacgtgaagacgcacagtggcggcggcggcggcggcggctcggcgggctcgggcagcggcggcaagaagggcagcgacaccgacagcgagcacagcgccgcgggcagcccgccctgccactccccagagctgctgcagccccccgagcccgggcaccgcaacggcctagagtgacgcccaccctgcgcccgcccctctccccgacctcctcccaccaagtcctcttgggccctgtctgtccggacttcaactccagcctttccctattgcatccgactcgctctctgtctctttctgtttctgcccctcttccttcttccttctgtgacttaactttgtaaaggggatatggacaagtaagtaacacgcatcgctgtcccgggccctggctttccctttccacgggtaacgctgcctgaacccgttgcagccggaacccgcgcctcgtcgggcctttatttctcgttctctcttccttgtcctcccctcctccaccccccaggttgtgaagggcgtaacttttagagggaagcggccactggaggtagagctggactaatccagtgcctggtagacagcgggcctcggcgcgggcaggagcggctcggctgagcaagcctgagccggagcggtggagagggagaggctggaggcctgggcagaacagcgccgcccgggcagacggctgcttggttccagagccgctgtactgagcacctcggcttcggagcaccctgccaggcccctgggcatcgccggacgtcctactcaggctgtcggggcttggtgggggtgcacttttggcagccccgagacccagagtttgtagagtttagatctcccaatgtcagctctgcctctttttctttgttccctgaggtggaaccgatgcaagtttcagcaaagggcagtcttgtcgaatcgctgcagcagctttctttcatctttatagcatatattttatttttaaaaaaactaggggaaaaatagcaaccttccatttggtttcccttctataatagttttttcctctaacggggagcaactctttctctcgaaactgctaatattgatcccaaagttactttgactgcattaacttaacttacggggtgggggcgggggtgagggtaggtgcttttttcttatgcaaaaatactcctttccggtgagaccagattaactatctccatgtttgtccttttctacctcgttttttcaccactcccaaacataacctcccaatcttttttgttagtccggccgtcaatttgtatagtaccaatttctgtaaattctctcaattcattgaagatcgtagggttaaacttttttgtgtgtgatttaaacttacaaacaagtgaagaagctatcgtttatttcagacgaggctgtagtttaaataccaaaagagggaaaataaaaaagaacctttgtaaaatatatctgaacctaatggtttgtacaactggagaatcgttctagattagttaccaattaaatataactccgccagtgtaagggtgtgaggtgcagttgtccaggagacgattttgtatagtatttttcttgtacattacttccagtaaatatttgaaaatatattgaagtaaacttgatttttttttttttgtcacaagaaaatattaagagttattgttgcagttctgatgagctgcaggttttttgaactcacttctggaggtgcagagccacaaacgcactttcggggcctagttttgctcgaatatgaatttagataggtatcaagctgtaactaagacaatatttgataaatgttggatgacatttaatttaatggagcatgtacttatttgcatttgctggcagttcaggcatagttaaagtgagagttctcctatatttcataataagtgggtctgccaaaacccatgtattaaataaattgtccaagtgaaactcgactaactttggcctttgtgtatttcctgaaggtaatattgttaactgttaataaatacttctgacactacatttaaatgtttgcagattctgcaaactaattgctcattgtaatgttgaaataatttggatatttcacattgaaatgaaaagcctttctctggagcattttagatttgcattttaaatgcatgaaatgtaattgatttatttgtaatattttaaatggtattaataaactcagataaaagact

SEQ ID NO: 1171 - DNA, 3126 bp, Homo sapiens
atactctcaacaggttttctcatttgctccttgggacagctcggtaaggatgatacagtcagttctatctcacagataatcaagctcaggctttcagagcctaagtcaccttcccaggtaagtggcaggattggaatgaggtttcatccctcaccctccctaaaggaccctgagcacccccttttagaagatgggcttccagggcttgagaaatgtcagattccactcccctgctattgtggccccatgggtcccccactccacaacccctctgggtgatgaggaagacagaagtgaaatcctgcactttatgccaagagactgggtgtgggaccgtatgagttggctgatcccttaagtggtgagtgggctcaggcagaagcttaggtgttggccttgggacaggtgagctgaagagaaggaaagtaacctgcactgaactactttaggcaaatgcactctatatttcatctcctttatcctaacggctgttcaaggtaccgatgattatgatcattattccaatcagggtgctgtctttaagggagtttgtgtaaatcagggagagaactttattatctccttattgtcagctaaatctggaattgatctaaaggttttttttttctctatttgccctgaagcccacagagaaatagaaatgtttttcttatcctttattcacgtttgttctgtattgatgagtatttagaatgtttctcattttttcctttttaaaaagatttcagcaatgctatttcaaataaccacttacctggctattttggacatgtgaaaattttttcctccattacatttgtaaacatctatcccttggggcttgatttcaataatttaaactcccttatatgtgtatgagcattctcatttctttaaccatctttgtacctgttgtagttacaatatttaagtgtatttataactgataagtgtgtttccatttccttgatgtatttggtccctcatcctgcccccatacacagacacacacagagcctttttcttttgcatctttttcttttgcaaattaaaaaaaaattctttttcggtttttttctacatttaaattttgtcagatgataggtgataaaaggatatttagatggtttcattagcattctttaatgtattagtgagctagaatgcattttcttgtgattactggccatttgcgtttcttcacctgtgaaccatatacatattttttcagttttgttattttgttataggagctgtacatgtgttaaacctaaaacccttcactgatggatgcatgcattatttcaacacatctttgttgggtgaatattatttatgagacactctagcaaaatccatgtcctagatatctcttctgagatcttggctcttatatttatgggagatgtccccctgcagcaagaaaagtattagtgcccatgtaaacatgcgtggcttgtcaaggatcacatgcacagacagttcacacttactcctaaacccggcatggccacagagtagaaagggtgtgtagtgcgttatatgaggagagcactggctcaggattgtgatttctgtgatctctatattaatggcaatgttttaaaaaattacataacatttctgagtttgccttttctcatttgtaaaatggaaacaattatagctaccaaagacaactgttctgaaagcaaaagaacaaaatattttaagcgtcatacacagcatagggtacgtacagtactcaacacatcttagtccctttcctatcccatacccgtccttcctttaaaggagattcctttgacataatccaaaaggcatggttccataacgatcacatgaaagttttaagggaaatgtataggtttccatgatgaattaactgctgtgtcactactctgtgctgggtaagaaaaaggaaaacaatcgctgaatcagtttcctagggtttgtaaaagaaatccatcaaagccaccacctcatttcgctttatttcacagacttccccatctcattttttatgttctatgctaatttctcaagaagaacaggcccggcaccacctctgcgcacaaccccgcgggcctggctcaggcgggagtgcggggccagcaccatgagcgccccgggcagccccgaccaggcctatgacttcctgctcaagttcctgctggtgggcgacagggacgtaggcaagagtgagatcctggagagcctgcaggatggtgcagctgagtccccgtacagccatctcggggggatcgactacaagacgaccaccatcctgctggacggccagcgggtgaagctgaagctctgggatacgtcggggcagggaagattttgtaccatattccgctcctactctcgtggtgcacaaggagtgatcctggtctacgacattgcaaaccgctggtctttcgagggtatggatcgatggattaagaagattgaggaacatgcccctggtgtccctaaaatcctggtggggaatcgcctacatctggcattcaagaggcaggtgcccagggagcaggcccaggcctacgccgagcgcctgggtgtgaccttctttgaggtcagccctctgtgcaatttcaacatcatagagtctttcacggagctggccaggatagtgctgctgcggcacaggatgaattggctcgggaggccgagcaaggtactgagcttgcaagacctctgctgccgcaccatcgtgtcctgcacacctgtgcatctggtggacaagctcccgctccccagtaccttaagaagccacctcaagtccttctccatggctaagggcctgaatgccaggatgatgcgaggcctctcctactccctcaccaccagctccactcacaagagcagcctctgcaaagtggagatcgtctgcccaccccagagcccacccaaaaactgcaccagaaacagctgcaaaatttcttaaggaaggcaccaaaaggaaacaagctggaatcgctccaggaaaaactctggttacacctggaagatggaagtcgcattgtagattcaagaaattagttttcagtttctcacgggaaccatgctgcttgggaatgtgtgtgatgccttctgtcaataaaaacacattacacagtt

SEQ ID NO: 1172 - DNA, 2865 bp, Homo sapiens
tttcttgccagatttgaaggcaattttttaaagctctccacatgtggtttactgtggaccaaacactggcagcttcaggcttacaatctgctgacaaactcttcttagttccttcaattgaagaatgtgagcatgcactgctcatgtgcctggcaagcacgcaaaccactcaggagaaggacagtggccactcaggtcatcaggtgaacttgtgacggggccatcaagaggctgcacatgagctccagaaaatgaaattcccactatcaacctattttccatttccgcccaatgccccgcccctgctccaaatcaaggtctccgcctcttagaaatgcttgattttcagtattgctaaacagggatcgaagaaaacaaactgaacaaagaaacaaataaagcctttaacacagtgagcaaagacacagcacctacgccttccccgggccccgcaacagctccagagctgcacagctgctcccagagcctgagcatggacctgagctctggctcatggatctcaccaatgcatttcttccctctgtgtcaaaaaagcatccagaaattggattcatttacttgggacataaaataatgtatacctacagttttgtcccagaactgcgtaaaccagcatgctgtctgccataatacagtcctccccctgcatcaggagcacagatgggggaaaccggcggggctggaggcctgggagtcacaggtgcttggaggggagagaaaagcaccacagagagccaggccctgcctacaaatcccatttttaggggtctagtggtctgtgcaggctgggagatgatctctaaaggaaaggcaagaaatattgccccacatctcccaccaccaaacagaaagtgcaggtggtcagccccagggctcacctgccctttgccagggtcatgagctaggcccaggctgcgcactccacaaaaccatcaaggggacgactgcctgccaggctgggacaactgcaccaggccctgacatcctgggaagaacagggttgcatttaacagaaacaactaaacctgcagggatgagcttgcctttccccagggccacgggatggtttatagaaagttctgcccatcaggacgagacctcacatgacaccatcagaggaactgataccatgccacagagggaggaagacggcacatgccataggtccgctggtcacagcacacacacgcccctgggaacttcagagccagcagtgtggctcaggtgccaggtcaggatgtgggaggacacagtgtctgggtgaatctgtcacctttgctagctgcctggtcccaccaggtagaagatgtggcaatgggagcacagcagtaggaagcccagtgtcccccaaccttccacctcacacccaggacctctgaggtgcatctatgtcctgcacatctaggctctgaaaagcaggaggtcctggtttccacagctgtggggcttctagacaggacagagccaggttctctaaaaaaaacaagctctgggtgctgctttgttctcaggctgctcctccatgggacctgcgggcagaaagatgtgtaccacctggaccatggtgtcagcaggagcagggctgtgctgcctggggaagaaggggctctacgcaagcgcctctcagtacacagcatttgatggtacctggacaagtgcgggagccctagaccaaggactcagtggtgagcaagactcaggaccccttaggggcgagggcctgggttacaccaccagggggtcacctggaccctcagcagaaggtgaaggggtgatcattacctttgcgaccctgaaatgggtggcagccacaggacacagggttcattgaacccaccttgtgtaactattgcccaggaaaaggcccagaatttaataaagacaaggcccctggcagtgcagtgttggatggggcgcaccccctggggcacccctgaccctcccccagggccttggctctgagctttgattatagacacacgtatgccatggccccttcagactgctcccttcacctttgaaaaaccagacaggatgcttctgttcctggaaacatgaatgcccttcatgtgtttttttctttgactagaaactcaacttcaaccaaaatatagactcccacacaataataatgggagtctttaacatcccactgtgaacattaggcagatcaatgagtcagaaagttaacaaggatatccaggaattgaactcagctctgcaccaagcagacctaatagacatctacagaactctccaccaaaatcaacagaatatacatttttttcagcaccacaccacacctattccaaaactgaccacatagttggaagtaaagcactcctcagcaaatggaaaagaacagaaattataacaaactgtctctcagaccacagtgcaatcaaattagaactcaggattaagaaactcactcaaaaccgctcaactacatggaaaccgaacaacctgctcctcaatgactactgggtacataacgaaacgaagacagaaataaagatgttctttgaaaccaatgagaacaaagacacaacataccagaatctctgggacacatttaaagcagtgtggagagggaaatttatagcactagatgcccacaagagaaagcaggaaagatctaaaattgacaccataacatcacaattaaaagaactagagaagcaagagcgaacacattgaaaagctagcagaaggcaagaaataagtaagatcagagcagaactgaaggaaatagagacacaaaaaacccttcaaaaaaatcaatgaatccaggagctggttttttgaaaaggtcaacaatattgatagaccgctagcaagact

SEQ ID NO: 1173 - DNA, 2477 bp, Homo sapiens
gaggctgactaccctgcggcggcgcggctcgcagtccttctcagcatggaccgcacttgtgaggagaggcccgctgaggatgggagcgacgaggaggacccagactccatggaagccccaacccggatccgggacactccggaagacatcgtgctggaagctccggctagtgggctggcgttccatccggcccgtgacctactggctgcaggggacgtggacggggacgtgttcgtcttttcctactcttgccaagagggagaaaccaaggagctctggtcatcaggtcaccatctcaaggcctgccgagctgtggccttctctgaagatgggcagagtgagtactggggaagacaaccagcaatgtggtggaagggagcagtgagcagcaccatgacctgggcaccttttccccagagctcattactgtctccaaggacaaagccatccatgttctagatgtggagcagggccaactggaaagacgtgtttccaaggctcatggtgcccccatcaatagtcttctgctggtggatgagaatgttctggccactggggatgacacaggtggtatccgtctctgggaccagcggaaggagggccccttaatggatatgaggcaacatgaagagtacatcgcagacatggctctggatccagccaaaaagctgctgctgacagccagcggggatggctgccttggcatcttcaacattaagaggcgtcggtttgagctgctctcagaacctcagtctggggacctgacctctgtcactctcatgaaagtacagctggttatggtgggatggaggggtgtgtgctgggggcttagtctgaggcagcttccacattgttttctctatttccctgcagtgggggaagaaggtagcctgtggctccagtgaaggtaccatctacctctccaattggaatggctttggggccacaagtgaccgctttaccctgagagctgaatctatcgactgcatggttccagtcaccgagagtctgctgtgtactggctccactgatggagtcatcagggctgtgaacatcctaccgaaccgagtggtgggcagtgtgggccagcacactggggagcctgtggaggagctggccctctcccactgtggccgcttcctggccagtagtggccatgaccagcgcctcaagttttgggacatggcccagctgcgagctgtggtggtggatgactaccgtcggcgcaaaaaaaagggaggaccactgcgggctctgagcagcaagacttggagcaccgatgacttcttcgcaggactgagggaagagggagaagactccatggctcaggaagaaaaggaggagactggggatgacagtgactgaaggaatgaattgaatcttgagacgggtcctcaccagggtgcctgtggagaaagaatggagtcactgtttaaccatggtacctgcctcagccccagcagaccacaggaggttggccccagactcactgagtgcctgcagcagccgtacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttggaaccctaacttgtcccttgccaaagccaactggctgccctctggctgtggggaccgcaagaagggacccacaagctgctggcgaagtcgctgcttcaggtctggcttgagccactccacagccacctgctctccacagaggtgtgactgccctgtaggaaaaatgcaaagacaagggcaggtctaaaccctgggcccaagcctccaggtggtgagccctttggagctacacagtcctgttatttgtagccttcccatttcctggtagtgtgaccatgggtaagaaaagacaatgaagccttcagcctccattatttgcaaagggagtataacacactgctaccttacaagtttccttggagaagtactggttaattgcaggctttgtctgcctcataaccatcataatggctaatctttactgggaaaacttgctgtaagtcagtcagtgtgctaagtaccgtacacccattatgttacttaattctcataacagtctgaggaaacagattctatagtagtaaaaagctcagttggattcccttgagcaaatcaatttctctaacagtttcctcatagcttgagggtcctgtgcctattttgcggtgtgggggtgggggaaggttgagaattaagtcaggaggtaatgctcgggaagtgtcacaaatttaggtaagcggtggtggtagcaccattggaagttttaaaaatctgagatcaaatagtaaaaggttgcaaattctggc

SEQ ID NO: 1174 - DNA, 1958 bp, Homo sapiens
caataaggagatgtcagatgtgaccttcctggtggaaggaaagctgttttatgcacataaagtcctgctggtgacagcttctaacaggttcaagacactaatgaccaataaatcagaacaggatggggacagcagcaaggccatcgagatcagcgacatgaagtaccacatttttcagatgatgatgcagtatctgtactacggaggaacagaatccatggagatccccaccactgacatcctggagctgctgtcagctgccagcctgttccagctggatgccctgcagaggcactgcgagatcctgtgctcccagaccctcagcatggagagtgccgtgaacacctacaaatatgccaagatccacaatgccccagaactggccctgttctgtgagggcttcttcctcaagcacatgaaggccctactggagcaggatgccttccggcagctcatctacggccgcagcagcaaagtgcagggcctggatccactgcaggacctgcagaacaccctggcagagcgcgtgcactctgtctacatcacctcccgggtgtgaggcagggggcggaggctgccgaggccagggcctgtggaggtgccagggcccaccatgtcggggtatggttgtaggccctcttggagccaggttcacggggctgtttcctcctcctcccccagatgtcccccctgtcaccgggcagctcaccctcatctcctctgccctagagctgtttgttcaatcactgatgggcaaaggggagatgtagctaactggtggccctcctccccatctcagtttgcaactcaagggcagccatgcactccccctgggtgtcgctctcccctcctgcaggtcagcagctgatcctgatccacctccgcccaggccctccaagctctactcacccctagggcctcagtaaactcagaccatcccaactggggctcctgggggtacaggaatccttatgaatgtatagaatgcatactgcctaggcccccagtcgtctgcagtaattcaaaagctggtatttttcttcctaaatgtcacatagcaaaggctgcccaaatccccaaacttgttcttcaaaggtttgacaggcttaatgtgggcatccagtggcctgtggacccccccctgccaccacgactgctgccacccggagttcccccattgtctttggtgcctgggcttccagagtccctcccatcaggactaccagcttgctcagttagcagcagagggcagttccccagcttgatggtttctgagctaagtctggcatggaggggcaaggggtaggggatggggtgctgtgtaggaatggcctcagctcttgttttgctgctggttttaggggccaaagtaaatgggtggattctggaacctcaggcctagactaggttgcctttgtgggggcgatgaagcagagtcccctggtcaagtctctcggctcctttaatgtaggattgagagctgggcaaacaggtcccactggggactgtgactcttggagattaaaggacagggcattgatggaaggtaagggccaggagaagaggcctttctgctgtgtcccctcacggccttgccctcgaattctgcaggccctgggctcccctgacacctgtcatatttatggaccagacactggggcagcatcaggcacagtctgtctgggtgcaacttcttcagctgtctggctgcaccttaaaaactatttattcaccaaaagccccaggcatttcagaaggtggcactcaggtcaccctgaaaagcccccaggggcttgcaattctggaaaatattttgactagctgcttggctggatgtacaaagaaataggcattgttttattgctgtaatattgtatgatactttaactgtacaataatgttgtcacttactgtaaatgtactatggttttattaacaataaacactcattaacaatg

SEQ ID NO: 1175 - DNA, 2567 bp, Homo sapiens
ctttgtaatttgtagcaacaaacctggggtcagacactccactgcctgtgcatcttgcctgtttccggatccgccgtgtcacagacattttctatgtcagtgcctatggctctacccagggtgatgctgctgatctggtctgattcccaagctggaggtaatggcgtgtgtcctgccctagtgctgctccctgatggggagcatgctcagtttcctgcattcaggtacgagcagagacttggcaggatccgccccgttcagagttgcaggaagagccctggatgcctgtcgcaaattggaataagtgggagggagccacaggctggtacagagacaaggtattgctgtgttgtccaggctggtcacagactcctggctgcaagtgatcctcctgcctcagcctcctagagtgctgggattacagacgtgagctaccacacctggcttttcattccttttaatggctaaataatgttccattctatagatacatatttttttccccattcatcagttgaaggacatttgggttgttcctagtttttggctatggtgagtaatactgctatggatattcatgtacaggtttttgtgtgaacatatgttttcatttctcttgggtacatacctgggaatggaattgctggttcaaatggaaactctttaagtttttagtaactgccagactgcttcctaaagcagctgcaccattttacattcacaccagcagtgtatgaaggatccagtttcttcacgtcgtcaccagcacttgcctgtctttgtacaccaatcaaaggtgtatgaagtcgatctcattgtgtttttcatttgtatatccctgatggctaatgatgttgcccatctcttaatgtgtttatttggtcttttgtacatcatcttgtggaaaaatgtctgttaagatggtttgcccatttaaaaatagtgttatatgtcttttattattgagtaacagttctttatatgttgtggatacaagtcctttatcagatgtgtgattttaagtatgttctctcattctgtgggtcatctacacgttcttaaaaaattttttgagacagaggctttttaaacaaatttttttgagacagagtttacctcccaagctggagtccagtggtgagatttcggctcactacaaccaccacctcctgggtccaaatgatcttcccaccccagccttctgagtagtttggactacaggtacatgccaccacacctggctaatttttgtattttttgtagagatggggtcttgctgtgttgcccaggctaatatcgaatgcttgggctcaagctatctgtctgccttgggttcccaaagtactgggactacaggcgtgagctgctacacctagcctgcatcttcactttcttgatggtatcatttgcagcacaaaacttttatctattttttttcttttgtttgtggttttggtttatatttaaataggcttcacctgacccagggttttgaagatttacttttatatcttctaagagtttcatagttttaggttttacatttaggtatatggtccattttttttgtgtattgcataggaaagggtcccaacttcattcttttgcatgtggatgtgaagttttcccagcaccatttgttgaaaaggcgattctttttctgttaaattttcttggcacctgtgttgaaatcaaatatgcagaggtcttgacacactgttactgtccagtctctacacatgctgtccttctctcccacaaagtgtaataatgtaataatgcaataacgtgcctgataaccaaatgagtggatttcagcagtccccctttgtctgaaacctttgtgatcagagggaataaacatcttagaggcatgaagcccttgctcagataaggagaagatagagaaccaaagtgccataatgtaccaagtaaaaagcatcagatgtgccagaaaataagcagtaggaattaactttgagggttatcacaggaacactatgtagagtaagcacaagcagctcagctgtggacgagctttgctgtagattttgctgcaaacctctgcaggcctgagagcttgccgtgggtccagagagcagcagatgtacttggctgtgacgtcactggatgtgtcctgatctactccttctccttctcatacatgaggttatctgaggtctcagccaagagacaaatcagcactttacccacggacagcaccaaagctcgccatcttggccgctgccccagaaccttggaaacttctgcagtgaaatggattctgattatttttattacctttgttctttttttagaattgaagtctggaatacataaagtgtgttaatattaagtgcaacttcgtgaccttttaattgaggtattactgtgtaaccatcaccagattaatatatggaacatcataagtaccctgggagactccttgtgctatttcccactcagtgctctcctcttaaagaggtcagcactgttccggttcttctattaccatatatttgttttgcctgctcatgaacttcaaataaataaaaactatggtatgt

SEQ ID NO: 1176 - DNA, 2341 bp, Homo sapiens
atgattcctgctctggaaactcaccgagccatttcagctgcgctctagaggagcaaacctggggcgttagctcaactcttgcccccctgctgaaggagaccaaaacaatgcttgatcaggaaacaccatctggctttgcccccaggattctgtgactgccctggggagggcgcagtgacctgccaaccaaaattggtacaattgtaaacagccacagaaatgcttaaatgcaatatcatttctatgaaattaacgtgtttccattccattccagccaccaaaattgcccgtttgagctcagccctcaaaacaaagatgcctgtgtggctttgcccaacgttgggtcactgttttctgcataggagacagttactgtgtgtgtgtatgtgtctgtgtctgtgtgtgtgtgtatgtacgtgtacacacttaaagcctgttgcaaaaacaagatgcccaatatatttcttgtttctgatattttcccaagggcgttgaagggcaagattaagaaggaaagctccaagagggagctgctttccgacactgcccatctgaacgagacccactgcgcccgctgcctgcagccctaccagctgcttgtgaatagcaaaaggcagtgcctggaatgtggcctcttcacctgcaaaagctgtggccgcgtccacccggaggagcagggctggatctgtgacccctgccatctggccagagtcgtgaagatcggctcactggagtggtactatgagcatgtgaaagcccgcttcaagaggttcggaagtgccaaggtcatccggtccctccacgggcggctgcagggtggagctgggcctgaactgatatctgaagagagaagtggagacagcgaccagacagatgaggatggagaacctggctcagaggcccaggcccaggcccagccctttggcagcaaaaaaaagcgcctcctctccgtccacgacttcgacttcgagggagactcagatgactccactcagcctcaaggtcactccctgcacctgtcctcagtccctgaggccagggacagcccacagtccctcacagatgagtcctgctcagagaaggcagcccctcacaaggctgagggcctggaggaggctgatactggggcctctgggtgccactcccatccggaagagcagccgaccagcatctcaccttccagacacggcgccctggctgagctctgcccgcctggaggctcccacaggatggccctggggactgctgctgcactcgggtcgaatgtcatcaggaatgagcagctgcccctgcagtacttggccgatgtggacacctctgatgaggaaagcatccgggctcacgtgatggcctcccaccattccaagcggagaagccgggcgtcttctgagagtcagggtctaggtgctggagtgcgcacggaggccgatgtagaggaggaggccctgaggaggaagctggaggagctgaccagcaacgtcagtgaccaggagacctcgtccgaggagtaggaagccaaggacgaaaaggcagagcccaacagggacaaatcagttgggcctctcccccaggcggacccggaggtttcagacattgaatccaggattgcagccctgagggccgcagggctcacggtgaagccctcgggaaagccccggaggaagtcaaacctcccgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggttcgctgacacagagaaaccccaacgcgaggaaaggaatggccagccacaccttcgcgaaacctgtggtggcccaccagtcctaacgggacaggacagagagacagagcagccctgcactgttttccctccaccacagccatcctgtccctcattggctctgtgctttccactacacacagtcaccgtcccaatgagaaacaagaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaggcacc

SEQ ID NO: 1177 - DNA, 2722 bp, Homo sapiens
atttaaagttataccctttctactttataaagtattccaagaatctacatccacacatgctctttaagtttttgctgacagacaatagccagttggaaatgattttggtgtgtgagtctttgcctcccagcaactggtgcccaggctcaactgagatcttactctcactaaacaggatcctgtcttccaccaagacttacgcaattgtgaattccccaaatgaagagggttgagatgtgcaagaaaaaaagagttctccccagacctgtggacaatgacagccttctagaaactgggtttctctacagcttctggtgtcaggtctgctaagagtttgctggtggtccactccagacactgttttcctgggtatcaccagcagaggctgcagaacagcaaagactgctgactgctccttcctctggaagcttcgtctcagaggggcacacgccagatgccagccagcgctctcctacatgagtgtaaacaagaagacatcaaacatggagacctaaaggctgttccagcagtaaacggaaacactcctctcagctgctcctgtcaccacggactgagggaaagcggggagattgtgcaggcatgtgagcaggggccagggtttggcaactggggatggacttttctggggtgagtttgtggtaaaatcagttgctggtcttactctctaaaagtaagcaggaactttcaatgtgctgtaggactcctgggtgcgattaccaacatgaaaactggttattagacacttatgacaagcagggcgtatagctcaggggtagagcatttgactgcagatcaagaggtccccagttcaaatctgggtgccccctactgcactttttctattcatacaagctgttatattcttcacagaagctgttggtcacattccagtttcttttcatccattccacctatgattttccctggaactggaagctacagctcaggcctacccagctgcaacctggctggataacttctcccagcaccagttccacgggtatccctcatattcttggtattcttggtatctagctccctgctccccctatagatgtaatttctcaagctgtgatgcagtatgcttctgggtttttccagggcagaccagagagtagtactgcagcaggctccccagaaacagatggggaatggtaccccaagttatcactctcctggctccttcccacagcagcagtttggtgcactggagtggtggccagacctggggagacacatcacagcacacagcattcccatggagggcagatgtttcccctggagaattgctcccacgcagggctcactcacacccttgcttcaaccttgtaggccaaaagcctggctcagctactctaacaagggagacagaggctctgcagtgctgcccctacgaccaaactcctgtagctctgcggctgcacgtgaattacagcccactctgtgactgtggcccaaggcttggaggtgggggattagactcaagagtctgttcgtatgagatgattgggaattccaactttgttctgtgggccacagggagtcctgtgtgctgcaatgaagaaccagtgaggtcctttgtctaaggaggtcatttaggagacattacagatactggtttggagtttgccaaaagacaagaacaggaactggtgttatttttttaatgcttactatgccctactatgtgctaatatcatgttaggcagtttatcatcagttatcatatttgtccactctgtcttcactgcaggaaaaagggagccgggctgggagcttgggttagtctgtggactgttttggacaccagtggccagctcttgggttaaccccaaaaaacaatgggaaatggctctgagttctgcagacagcctccatccttttctcctgctcatggctccacccagagacagacctggtgaactgcagagctgagggaaggtgtctagctgtgaatcaggtctggcagcttccagaaagtcagtcctggagggaagccatcatttaattttacaaagctgagtgttcccatactgataaaaggtactaactaggtaacctcagtgtgccatgggggtaaagctctgggctagagcttttgactgtagagcaagaggtccctcgctcagatccaggttctccattctttatgttcaatgttggtagataactttatccacatacaacttagactggcataggccacacagagggtagggtcaccttctcagtctcattctccacgttgcccccaaacaccagctcctccactatccctccacgcttctcctctctcaaaaccatctccttccaccactctctcctctcaccattcatgtcttctctgacatatgggactccacaaacagtggacacttttagaaccaggctaacaatcttattttcctcaccgccctctccttctgtcctcaggaatgtcaaacaccatggcaatgtgcgtccaatgctaaggcctcccgagatttccatcctgctgcctctacgaatgttcacaaactccactcactgaggctctcaaggggtgtggtgaggcagagtcagcgttttccactagtgtcttttaccctgcttcttgaggcaggagaatcgcttgaacccaggaggcagaggttgcagtaagccgagatcttgccattgcactccagccagggcaacaagagcaaaactccgtcccccaagc

SEQ ID NO: 1178 - DNA, 2463 bp, Homo sapiens
acactgtggaagcccagagaatctgatcccgggtcccacaacttcacatatcgcgagtaagtgggaggcaaagaaaattctttttctcctcttttgggacagtttgtgactagtagtgcctgtgcccctggaaaggttggagacttgggggacgactggagaattgccatttgaggaccaaaggagaaaagaaactacacgctaattctagaaggcctcctgtccctgcctgctctgggtgctcatggaaccagctgctgccctgcacttctcccggccagcctccctcctcctcctcctcagcctgtgtgcactggtctcagcccaggtcactgtcgtggggcccactgatcccatcctggccatggtgggagaaaacactacgttacgatgctgtctgtcacccgaggaaaatgctgaggacatggaggtgcggtggttccagtctcagttctcccctgcagtgtttgtgtataagggtggaagagagagaacagaggagcagaaggaggagtaccgagggagaaccacctttgtgagcaaggacagcaggggcagcgtggccctgatcatacacaatgtcacagccgaggataacggcatctaccagtgttacttccaagaaggcaggtcctgcaatgaggccatcctgcaccttgtggtggcaggtgcgttgcttcattttgctttgttactttggcactgtgtgactttgggtaaagcttctcttctaaattccagcccattgcagaccagcacaatcctctttcctggatccccattccgcagggacactctccctatgaaaagaagattccagggaaaaatccttcctcctgcacaagggccaccatgagtgagtttgccctgctaagccgtgggcttgacttcttgagaagcacatgcagaactcagttgaggccatgagccggggaaaatggtgaatctcggaagagaagtcctatgcctgccttagcactgagctgtgcacttctgagagtgagaggagacaccatcaataattgtcttgggacaactggaataaacagtgactgcccagagaactacgatatttgaaatcttatttcttgatgaatattcatcctgacttctttcctgaaatgctgtttgcaaagagagtgacttatatgactggactctgagcccgtcattgaaatgagagaccacgaggacgggggcatccagctggagtgcatatctggagggtggtacccaaagcccctcacagtgtggagggacccctacggtgaggtcgtgcctgccctgaaggaggtctccacccctgacgcagacagcctcttcatggtcaccacagctgtgatcatcagagacaagtctgtgaggaacgtgtcctgctctatcaatgacaccctgctcggccagaagaaagaaagtgtcatttttattccagaatcctttatgcccagcaggtctccatgtgtggtgatcctgcctgttatcatgattattctgatgatacccattgccatatgcatctactggatcaacaatctccaaaaggaaaaaaaagattctgtcagggcaaaaggagcttgaacaggaaaggaaagaaactgcactaaaggaactggagaaagaacatgtggaaaaagagaaagaacttcagataaacagtaaaagaggccagagcaacttctgaagaattgcatacgtttagcctttcctgaactactccatgtacaatttgtgttctgctcatttagcagcatctcatgacattcaacctctgtctgtcccttgcaggatggagaagaacattcttacatgctgggtgccctcgtcagtcatttaaatcagttgtcatctggtaaaaggaacacataggaccaacgaagaaaccctttatcctccaggacagtgtgaagggaaagactcaccttagttgatccaatggggagaggaggagcaggacataaagcctctgtgctggtttgagccaagttggaaagtttctaactaaagaaagtcccagagatcataggtcttgaatagaaaagggaatagattttagaatgctaaaattgtgaatgattaatttgggctcattccccaaattctctggatttcataaagcctcagttcttctcaacctgagggtgctgcttactgtctctggagagacagaaatgcagcttcagaggccaggatggtggctcacacctgtaatcccagcactttgggaggcagaggtgggaggatcaactgaggttgggcattcgagaccagcctgaccaacatggagagaaaccctgtttctactaaaaatataaaattagccaggcacggtggcacatacctgtaaccccagctccttggggggctgaggcaggagaatcacttgaacccgggagacagaggttgcggtgagccgagattgcaccactgcactcaggcctggcaacaagagcaaagctcagtctc

SEQ ID NO: 1179 - DNA, 2255 bp, Homo sapiens
ataacaaattcttcactggatgggccagtgctataatttggaggatgatgacttggaaacagacgtgaacaagctgagttccaaacctggtcttgaccgacctgaagaggaactgatgcaatatgaggtgatgtgtcttgagctctcctatagctttgaggaactgcagtccaaacttggagatgatttgaactctgaaaagactcagtatgccaatcaccaccacattccagccgctgcctcctcaaaacagcattgctacagcaaggaccaaagctcctgtgggcaagaaagagaatatgctgtccagacttcccttctgtgcagggtgaagacgggaaggtccactgtgcatctaggctccaaaaaaaatcctggagtgaacctgtaccaaaatgtgcaatccaatagtctcaggagagattcttctgaaagtgaaatccctgacattcaggcttccccgaaagcagatgcctgggacgtagatgcaattttctgcccaaggatgagtgcctccttttctaattccactaggactagagaagttgccaaagtaatagataagcttctgcagacacatctgaagcgtgtccctttccacgatccctatctttatatggccaaagccagaagaaccagctctgtggtggacttcaagatgatggcatttcctgatgtctggggacactgtccccctcccaccacccagcctatgttggaacgaaaatgtggagtccaaaggatcaggatatttgaggatattcggaggctcatccagccaggtgatgttataaataaagttgtcttcagtttagatgagccttggcctttgcaagacaatgcttccaattgtttacggttcttctccaaatttgagtcaggaaatcttcgcaaagccatccaagtgcgtgagttcgagtatgacttgctggtcaacgcagatgtgaatagcacccagcaccagcagtggttctatttcaaagtgagcggtatgcaggcggccatcccttaccacttcaacatcatcaactgtgagaagcccaacagccagtttaattatgggatgcagcccaccctatattctgtgaaggaggatcttcttggcaaacccacctggataaggacaggccatgaaatatgttattacaaaaatcattatcgccagagtacagctgttgcaggcggagcatctgggaagtgctactataccctcacctttgctgtcaccttcccacacagtgaggatgtctgctacctggcctaccactatccctatacctacacagccctcatgactcatcttgacatcctggaaaagagtgtcaacctcaaagaggtctacttccggcaagatgttctctgccagacgctgggagggaatccgtgtcccttggtgaccatcacggccatgcctgagtccaacagtgatgagcatctagagcagttccgtgagtaaaatgggatcctcttcgtagaagatttgactaagggtgtcctttatagtcttggaagcattctgtctcttttagatcaaaagctccataaagggttggagactgtctgtctttgtagaaatacacccccagcttttcttggtgtgacacaaaggttaaacattaatgttgctttgttgttaaagggagagaaaatgaaatgaattcaaactgtccggcagatgaaatgacagtttgctaatgatggtcacttcctctcttaaaacagaaccaggaccctgaatcatattttccaacttctaatccagggacttttctcactgtgctcactgctgttatgtgactctcagtcagtcaaggtttggaaagaaagaaagttgagtttttaagccctggctaaagaatccccttgataacctgaataccatttgtgtctgaagggctgaagatgtggacaggctctagctaagaactttgaaacaaagtcaaagccaaactcatgcacacacacgcagacacacacaaatatacgcatatggacatatagacaaacacatagacacatgtagacacaaacatatacacagacgtgtagacacaaacatatacgcctagacgtgtatacatgtgtagacacaaacatatacacagatgtgtatacacgtatacagacacgtacacacaaacatctttaaatgttgggcttctgtgcctaagtgcatatgtgcgactgacctgttgacctgttacgaactagcttttgaaaatggcttctgacatcatttcagaccttaggtaggc

SEQ ID NO: 1180 - DNA, 2521 bp, Homo sapiens
ctgtcctcctgcagaggtggctgtggtcctggacctatgggcccttcccttcccccaacattgagctttgtgtgtctgcatggaggaggttcccaaggtctcatagtataagctgttcaagggtcagagaagcccccaggtcctgccttttcctgtccctttatgttggggagttgggggtgttacaggtatgctaaactctttagctgcagtctatctacccatgccagattcatcaagatcctcgatagtgtcctgcaccacctggtacctgcctgggaccacacactgggcaccttcagtgagattaagcaagtgaagcagttcctactgctgtcccgccagcggccaggcctggtggctcagtgcctgcgtgactctgagagcagcaagcccagcttcatgccacgcctatacatcaaccgccgtcttgccatggaacaccgtgcctgcccctctcgagaccctgcctgcaagaatgcagtcttcacccaggtatatgaaggcctcaagccctctgacaaatatgaaaagcccctggactacaggtggcccatgcgctatgaccagtggtgggagtgtaaatttattgcagaaggcatcattgaccaagggggtggtttccgggacagcctggcagatatgtcagaagagctgtgccctagctcagcggatacccccgtgcccctgcccttctttgtacgcacagccaaccagggcaatggcactggtgaggctcgggatatgtatgtacccaacccctcctgccgagactttgccaagtatgaatggatcggacagctgatgggggctgcccttcggggtaaggagttcctggtcctggccctgcctggttttgtgtggaagcagctttctggtgaggaggtgagctggagcaaggacttcccagctgtggactctgtgctggtgaagctcctggaagtgatggaaggaatggacaaggagacgtttgagttcaagtttgggaaggaactaacattcaccactgtactgagtgaccaacaggtggtggagctgatccctgggggtgcaggcatcgtcgtgggatatggggaccgttctcgtttcatccaactggtccagaaggcacggctagaggagagcaaggagcaggtggcagctatgcaggcaggtctgctgaaggtggtaccacaggctgtgctggacttgctgacctggcaagagttggagaagaaagtgtgtggggatccagaggtcactgtggatgctctgcgcaagctcacccggtttgaggacttcgagccatctgactcgcgggtgcagtatttctgggaggcactgaacaacttcaccaacgaggaccggagccgcttcctgcgctttgtcacgggccgcagtcgcctgccagcacggatctacatctacccagacaagctgggctacgagaccacagacgcgctgcccgagtcttccacttgctccagcaccctcttcctgccacactatgccagtgccaaggtatgcgaggagaagctccgctatgcggcctacaactgcgtggccatcgacactgacatgagcccttgggaggagtgaggcgtgccgccggctgtgggaccagcaagactgcacgtgtccctcttggccttgcccagggcgaagacaccttccctgccctggtttggctgacgtgctcagcaaaaccccatgtgccctgctcctgtgtgcagttggggtaggggcagctggcatggtcaggtaacactagtggcccagccccgcagacccacaagccctacccgtgctggggcttgcttcccgaggtatttcacctcttaagagggaatcttccacaagcccagcacaagctgccaggcctgagctacttgaagggggccatctaggtccccaacccatggactttgcctccattttcagctccgccttttttctcctattttctctctggctttcttcagccatgactcacaactaaaaacataaaacactggaggttagtggaggcccctccccaagcagggagcctgggatgggcagggagtgatagccaaactccttggtcacctgctccaagaaggaagcagtagctgagcacctgccctcacatactgctcttttcccctctccctccacaccagagatgtggtgagctctgttcttctaccaacccagtctcaacacacaaagtgccaccaccttccctgactcagaacccacatccactcaatgtgaactctactaccacgacctccccatattcctcacttctccatcacctccagcctgactccctgtctgccctttcacccccaagattttgcacaggttaaggccagttatggcctttttgaaatctgtaatagctcccctttccccaactctaaagcctagaccttaaacctgttcctagagctatgcacacccctgccccagtttaccgttcctccctcagggcctccgtgacactccatgaaaagaagttcttgcataccggaaagttgaataaatggatgaattc

SEQ ID NO: 1181 - DNA, 2097 bp, Homo sapiens
gaaaaaaacgttgctgattagagctgccgggtcagaaacagctgtgagacactaaagtccccactgttataattattcaatatgttcccactgactgaggaaaacaagcatgtggcccagttgttgctcaatactggtacttgtccaagatgtatcttcagattctgtggtgtggattttcatgcaccttacaaacttccatacaaggagttgctcaatgaactacagaaatttctggaaactgaaaaagatgaattaattttggaagttatgaacccacctcccaagaaaattcgactgcaagaactggaagatagtattgataatctaagtcaaaatggagagggaaggatctctgttagtcatgttggaagcactgcttccaagaactcaaatttaaatgtatgtaatgtatgcctaggaattcttcaagaattctgtgagaaagatttcattaaaaaggtgtgccaaaaggttgaggcctctgggtttgaattcaccagcttggtattttcagtctccttcccaccacaactatctgtaagagagcatgctgcatggttgctggtaaaacaggaaatgggaaagcagagtctgtcgctgggaagagatgatatagttcagctaaaagaagcctacaaatggataactcaccccctgttttcagaggaactgggtgttcccattgatggaaagagcttgcttgaagtgagtgtggtctttgctcacccagaaacagttgaggattgccacttcctagctgcgatatgcccagattgttttaagccagccaaaaacaaacagtctgtattcactagaatggcagttatgaaagccttgaataagataaaggaagaggatttccttaagcagtttccttgtcctccaaactcaccaaaggctgtatgcgctgttcttgaaattgaatgtgctcatggtgctgtttttgtggctgggagatataataaatactccaggaatctaccacaaactccttggataattgatggagaaaggaagctggaatcttcagtggaagaattaatttcagatcatctgttggcagtatttaaagcagagagttttaatttttcatcctctggaagagaagatgtagatgtgagaacattaggaaatggaaggccctttgcaattgagctggtgaatcctcatagagtacatttcacttcacaagaaattaaggaacttcagcagaaaattaataactcatctaacaaaatccaagtacgtgacttgcagcttgtcacaagagaggcaataggacatatgaaagaaggtgaagaagaaaagacaaagacctacagtgccttaatttggacaaataaagcgatacagaagaaagacattgaattcctaaatgacataaaggacttaaagatcgaccagaaaacacctttgcgcgtccttcaccgaaggcccctggctgtgcgagctcgcgtcattcacttcatggagacacagtacgtggatgagcaccacttccgcctccacttgaaaactcaggctggcacctacattaaagagtttgtacatggagacttcgggagaaccaagccaaacattgggtccctgatgaatgtgactgcagacattctggagctggatgttgagtctgtagatgttgactggccacctgctctggatgactagctttcaaatttggagacaaagagtatggttttcctggcatgatgtggacatccatggagcacatgccgtaaaatggctgtttacccaccataacggtgtcttgaaaactatttggatcatgttgatctatataattgttaatttgttgtaacatctcaggatctatatatgtgtatattttgtgttaaattgttccaaggatgtcttaggatttttctcattccctctttcacccccacaaaccaaactatgaataatgaaataattctccttaattctttcatttagagaggtgcacaaacaggacacattctctgttaacctaagaagctgtaatttcagcaagatttccctccacaagagatataccacctttaaaatcatgttctaatttttgtaaattatctgaataaaagttatatctag

SEQ ID NO: 1182 - DNA, 3342 bp, Homo sapiens
aatgctcctcccgcgcagctcttatccccgtagactgcggccgagacggggagggggaagcctcgcctggggggcggcagtggcctgggcggctctccggctgctgttgtatggctgcacgttggcgctaccggacgggatgctgtatccccgagagagcccgtcgtggcagcgcaagcagctggacggcctctgaagcttccgcgccgacttctccgacaaccgacgccggggcttcgaggagcagaggtaccggcgaccgctgtcggaggcgcggactcggggcagggccaggagtcgcccggaagcccggcggtgggaatgggtcaggccccaccgtggacatgccggttccctccagcttcaacgacatcggccagggctggcggctgcggcattttgtcagctggttgtggtatgaacgggaggtgaccctgctggagcgatggatccaggacctgtgcacaagagtggtgctgaggattggcagtgcccacttctatgccatcgtggtatcccaagggttactttgtccagaacacagactttgacttcttcagctacgcaggactgctgtggtctctgcttctatacacgacaccccccacctacatcgatgacgtcaccgtcaccaccggcgtgaagcgagacagtggtgagggcttctggactggatggaggacctgaagacatgaggtggaggcacaggtagaagagaagattctcaccatcgctgattcacacaaaagcatttctccaagtggttgcagatgacatgatttcccaaagtgttagagctgaagtgtgtttccttgtgtatatatactgtggttcctttatcccttcatctgtggatagacaggtgcaaccgtgtggttccccacgatatgatttcattgtggttttctgtctgaagagtatcccagtatgtacctgtggagcagcttctttatcccttcatctgtggataagcaggtcatgtcctccaggtttctgcacgttgctgcagatgacatgatttcatgaatttctgcggccgaagaggattccactgcgtgctgcagtttctttatccctttatctgtgcatgaacagtgcaggccaaggccccctgcccatggaggtgtgctgcagacagcagcagcagcagcagcagcagcagcagcagcagaggcctggcttcctgaggaattgctggccggtttgaggaaggaaggaagtcccacctaccatgatcaccctccagcctggaggaagctccatgccagcagcatggaccagcatgggagccagagccctgctaatgctgcagctcatcacccctgctcagcagcccagcagcccagcagccattgccacatcccatttccagggcctcctgcccccatgcccccacgtgcccatggaccgacacaccactcttcctgttggcccaaggtaggcatggagggaatttttcaagtccacttttagtaggtaagtcaaaaccaaacaaaataaccactcgacacctggtccaatgcccttccaaactcactcttttctctgacccttaaacacttgtcctgcatctcccagactccactgtaccttgatcagtaggtccctcttcactgcagtgtcttttttgcagagttcttttagctctttcatgcttttgctatgggcagaggaaagaaagaagggtaaatttgggaatcaggggagatttgtgagttccagtcccttttgtttgaaaacccagtgaatcccagcttactgggtgagagttttcagtggagtcctctgatcacaggggctccagaggaccagggtgggacctctcatgctcctcccctgggccccatctccacttcacataagccactgcgtgtttacagttagctttcagctggacacagagttccactgctgggtacaaacacctgaaagcctccagttggctccagtctgttcctgatggttaaaaaaccttagtcctgagttggaaatccttgcctaggagtccagggcagcttagtgaccacagccaccggcccatccctgcctccagtgtccctggactccaagaacctttcagagtcattgagggcacatggggggagacctgtgagtccctaggtcaaccctgatgctgccatggagagagccctcctcacctggacactcctgcccacgtcttgtgtagctgacctattgggttgctgcacagagcagagacgatgacgtgcaccgaggagaagttgttgaggcttaggcactcctggagagggaagaatgagctgtgcggttcagagttggagcttggcccactacagcctcagccccctctgctgagatctcccctcctggatgaagcagaggcctggggagcctcaggagggcagacctggggccgagtggatgtcactcatctaggaggattttagttcaacccaaggaagaccccaggtcggaagtgagcagccaccactgggccgtgggagtcaagtctggagaaacagctacggccatcccagccctggccaaggggaaaatgccggaagactccagggtgggaggaagcgcgtcccaaggcccaggatctgcgaggcgacttggggaaaacgcaggacctgctgaagctcacacccgtggaccacccagactgcctgccgctacaggatgccctccgcatctcccaggacttctttccggcatcagtgtggacattgaccccactggactgcagtcacagtggactcccaaggggcaggatccacctctgatgttcagtgaagactaccagaaaagtctgctagagcagtaccatctgggtctggatcaaaaactcagaaaatacgtggttggagagctcatctggaattttgccgatttcatgactaaccagtgtcagcccaagactaccccgtcggtcattctgttcctgccgtcctgtgaggagccccaagccaacaaggccacactggtgtgtctcatgaataactttatccgggaatcttgatggtgacctggaaggcagatggtaccctcatcacccagagcgtggagatgaccacgccctccaaacagagcaacaacaagtacgtggccagcagctacctgagcctgacgcccgagcagtggaggtcccgcagaagctacagctgccatgttatgcaagaagggagcaccgtggagaagtcagtggcccctgcagaatgttcataggttccagcccccaccccacccacaggggcctggagctgcaggatcccaggggaggcgtctctctctgcatcccaagccattcagcccttctcgctgtacccagtaaaccctcaataaatatctttgtcagcc

SEQ ID NO: 1183 - DNA, 2768 bp, Homo sapiens
tttattgaaatatacatacaggaaagtgcatctatcataagtgtgcaaattgatgaattctaaaatctttattgtacctgtttagcacctagattgacactgaacataactaacaaccagaaatctccgtgtactcccttcctgtaactacccctgcgcccgaccaaatcactctcttctaacagcataactttgtgtgactagcttttttaatgtaaaagaatgaaatctacagcatgtattcatttgcatctggcttctgccacccaacattatatttgtgggattcgtttgtacagttgcatattagtttgcagatccctcactctcatttctatatggtattatattgcataaacgtaccacactttatccaactactgttaaatatttgtgcattttctacttgggggtgatttcaaatagtgctgctatgaacattcttgtaaatgtcttttggtgaacatatgcaacacatatatgcgttgttgttggttcccaggaggggcattcctgggtcataaacaatgcgtgtgttcaggtttagtacagtataatgccaaacaggtctccaaagtgtttgtgccactttacatacctgccattattgaaaaagagttctgtttgctccacattgtcaccaatacttgatattttctgttttttttttcttttaaaccgtactagtgggtgtgcagtgatattgcaatgtggttttaatttgcatcttccttgtgacaaccttgattactgtaagccacttggaaatgtgatttaaattcatataaagatatagtagcaaaacgcatactaggttactttcgtatccagaaagtttagatagaatgatttctatgtaagcttttactgtgtagtctgagtccatgaatattgattacaaaaaacacatctgtaggtgagttacaatacctcacttataattcaaaattcatgtgttagctcaatatttttcaaataatttttgcatgcaattttcaccttctttctgagtagtttcaggtattttgtatggttccagcagtcagttaggttgccattgtttggaagcacacatccacgtatctgcaccatgatgatatggcacgcccatacccctcatttcacattttgtcagaagtgcatagttatcactaactttgccagtagaaatgtactcccaatttcccacggacttatcttgaataatctctccactgaagcataacaggttttgaattctgttagaatagttgtttttactatcttttaattttatacaaatttcaaagttacgtaatacttttatttaaaaagtgaaacaaagcttttcctctcccttacccacatgttagtccagcagaaggggaaagcattggccccaggccaaaatcataaacgctttcaattaactaataataattgctggcatgttgccattaaatatccttgtctcattatctctggttgctttattaaacccataggtcactgaagcccacttttgagacaaagactatttctcccccaaaagtcaagggaaatataaaaaatgaaattagtgattaagaatagaagtcaattaatacaatcattttgtcttaattatttaaagtccagtttttttcctgcagcaaacctgaaaatacactatcctccagctatcagaattatattgagatctactcacatttatgatgatgttcagagattctcattgggaaggaaaaggcacacgctgcggtggtcttgcatgactctgttgttgtggaaattcaatttgttcattgtgttttgggctccctgggtggtcagggctgggctctgggtccttggcaattcctcaggttcccagcactccaaagccaagctcacctcctcatcacacgccctgcaggagaagcattagggtgtccgactacgtgggtttcatagctgtggaaaagccaaaggggagactcctgaagaaaggcggtgaagactgtgaagagcgggtcaggaagatgagcacagcactgctactcctgtgggcacagggacagcatgtctccagccagtgccaccttgtttaatacatgggaactcactgaaattcattctgtattttgcccgcaaagttttaaagctttcatccacagtcaggaattaaacttataccaatgagagcctcacacattcaaggatgtactaagcactacaggcctcacagaaacagagatcccatcttggagttttcagtcccacatgggagataaagggttttgaacatgaaatgacaaaaacaacagcaagaagaaaattctcgtcctttttcattactatcagactcaaataaatgtcttggctcttacattacattcattcttcaaccattgtggtctggcttccacttccttcacttcaccaacatggctctgccaaaggaagcccgtgatctctaggccatcactttaattgatctctctacaacatttatcctggtcgttaagccctccttacaacattcttctctctgtttttatagctccatctctcctgcttctttaacttgataatgcatacttgatttttctatttgttatttcataaaccaattaatatacagataaaatgactgtatatcaaaccatgtttgtatagaaaaaatggattttggatgcctctcatatgtaattagttctattaaacatattaattgtattgtttaatttgtcaggtttttgacagaattttgtttacaagtaataaaaattttatctccaattttcaat

SEQ ID NO: 1184 - DNA, 2457 bp, Homo sapiens
tgttaatcccctagactatggggaaaatgtctccaggcagccccttccatcacaggcccataggcccaggaggaaaaagtggttttgtgggccaagcccagggtccctgctgtgtgcagcctagggatttggtgctctggttcccagctgctccagttgtggttgaaaggggccaatgtatagcttgggctatggcttcagagggtgcaagccccaagccttggcagcttccatgtggtgttgagcatgtgggttcacagatgtcaagaattgaggtttaggaacctctgcctagatttcagaagatgtgtggaaacgcctggatgcccaggcaaaagtttgctgcaggggcaggtccctcatcaagaaactctgctagggcagtgcagaagggaaatatggggttggagccccccacacagagtccctactggggcactgcctagtggagctgcgagaagaaagccactgtcctccagaccccagaatgatagatccactgacagcttgcactgtgtgcctggaaaagctgcagacaagctgcagacactcaatgctagcccatgaaagcagctgagagggaggctgtaccctgcaaagccacaggggcagagctgtccaagactgtgggaacctacctttcacatcagtgtgacttggatgtgagacctggagtcaaaggagataattttggagctttaaaatttgactgccccctggattttggacttgcatggaccctgtaacccctttgttttggccaatttctcccatttggaatggctgcatttacccaatacctgtatccccattgtatctaggaagtaactaacttgcttttgattttacaggctcataggtgggagggtgttgccttgtctcagatgagactttggactgtggacttttgggttaatgctgaaatgagtagagactttgggggactgttgggaaggaataattggttttgaaatatgaggacatgagatttagaggggccaggggtggaatgatatggtttggctgtgtccccacccaaatctcaacttcagttgtatctcccagaattcccacgtgttgtgggaggaacccaggaggaggtaattgaatcatggtgtatggtctttcctgtgctattctcatgatagtgaataagtctcacgagatgtgatgggtttatcaggggtttccgcttttgcttcttcctcattttctcttgccgccaccatataagaagtgcccttcacctcccaccttgattttgaggcctccccagccatgtggaactgtaagtccaattaaacctcttttccttccaagtcttgggtatgtcattatcagctgtgtaaaaatggactaatacactacccaaaacaatctacagattcaatgcaatccttatcaaagtatcaatgtcatttttcatataaatagaaaaaacaattctgaaattcatgtggaaccaaaaaagaacctgaatagtcaaattgattctgaacaaaaagaacaaagcaagaggcatcacacagcctgattttaaaatatattactaggcaatagtaaccagaacagcatggtattggtataaaaatagacacatagaccaatggagaagaattcagaaccagaaataaatccacctacttacagctaactgatttttgacaaaggcacccaaagcatacattggggaaaggatatcctctttaatcaatagtgctgggaacactggatatccatgtgcagaagaatgaaactggaccccctcaccgtttacaaaaacgaactcaagaaggatttaacataaacattaaacataagacctgaaactataaagcaactggaagaaaacatagaggaaacactccagaacattggtctaagcaaagattttatggctaagatctcaaagcacaggtaacaaaacaaaaaatagacaaatgggaatatactaaactaagaagcttctgcacagcaaaggaaatggtcagcagtgaagagacagcctgttgagtgggagaaaatatttgcaactcttcatccaataagggataatatccagactatacgaagaatccaaacaacagaaaaaaaatctccacatttattctcattaaaaagtgggcaaaggacatggatagacatttctcaaaaggagacatagaaatgaccaacaggggctgggtgtggtggctcactcctgtaatctcagcactttgggaggctgaggtgggcagatcacgaggtcaggagtttgagaccagcctgaccaacatggtgaaaccccatctctactaaaaatacaaaaattagctgggcatggtggcccagcctgtaatcccagctactcaggaggctgaggcaggaggatcacttgaactcgggaggcggaggttgcagtgagttgagattgcgccactgcactccagcctgggcgacagagcgagactccatctc

SEQ ID NO: 1185 - DNA, 2784 bp, Homo sapiens
gatgccccgcccgcgcccatggcgcagccacacacgacctcggtcccgtacttcgcgcgctctcctgcaccgccgccgccatctcgctcaggagctcctccacaaccgccggcaacactacggccatcgcgccgcaggacacgccctccacgaccggcggaccgccgcgacgctccagctgactgcgcctacctgtggaggatcctgaccccccgccggggcagggcgagacggagtgacgtcggggcgcgtcatcgcgcgtgcggacgcagggatgtcctgctcagtcgtcagggcccggccaatccggagggcgctcggcgcgtggtcgggggccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcgacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttcataataaatgagactacacaac

SEQ ID NO: 1186 - DNA, 2131 bp, Homo sapiens
ttcacatttaagatacatatctatttatgtgaatgaatttcaaattagtgtatactaactaaattgttattaaattgatggctttattagcataggtttattcacttgtgttctgatgatttgcttttcagccttcttttcacatggaactttttaatttcataaatatacaagtgtgctgcacataaatttgttcacaataatttggaaattattaaaacattatattttttcagttgccaaaataatctcttcctttatttttcagcgctccctatggaaagtccgtggacatgtggtcggtgggctgtattcttggggagcttagcgatggacagcctttatttcctggagaaagtgaaattgaccaactttttactattcagaaggtgctaggaccacttccatctgagcagatgaagcttttctacagtaatcctcgcttccatgggctccgggtaagaggttttgctgaaacccaaaatggaatcaatactgcagtatttgagtcattgttcattgcacaatggaatgctaaactatcctttgaatactatttcttttcccattacagtgtttataatccctattataatattttatttccgaattttttaatagtacttgtggatttaaaaagtggttagaattcaaattctaatcttttttctaatttttaagttccagtttttcaaaatcttttttagtgtatacatttttacacactaaactttggttatcttatattgtttctttatccaaaatattaagcatcccccaaatataccaaatgtatgaatgttgaacaaacatatttgtagtgatttgaggaaagccctgaaaacttggattccccagatttgaaggttcttgttttagtagatgtttctggtccactgacggtgaaacatcaaatcttcttttcaaattagtgtattgtcttgggtccgtgcatggtggctcactcctgtaatcccagcactttaggaggccaagttgggcagaacacttaaggccaggagttcgagaccagcctggccaactttgtgaaaccccatctctacaaaaaaatacaaaaattagccaggcatggaggtgcacacctgtagtcccagctactcgggaggcagaggcaggagaattgcttgaacccaagaggcagaggttgcagtgagccgacatcatgccactgcactccagcctgggtgacagagtgagattctgcctcaaaaaaaaaaaacaaaaacaaaaaaaaacaacaactagtgtattgtcttgggcagcctttcctagacttgacaactttgtacaaaacttttctgagaatatgtgaaatagcgtcttagaaagtataaactttccccaaatgaggaggagtcaccttattagagtgcccagtgagttataggctacttcttccacctaccccaaaaacaactttttaagttttcagccagtttttttttttttattatactttaagttctagggtacatgtgcacaacatgcaagtttgttacatatgtatacatgtgccatgttggtgtgctgcacccattaacttgtcatttacattaggtatatctcctaatgctattttcccccctcccccaaccccatgacaggccccagtgtgtgatgttccccatcctgtgtccaagtgttctcattgttcatttcccacctatgagtgagaacatgcagtatttggttttctgtccttgggatagtttgctgagaatgatggtttccagctttatccatgtccctacaaaggacatgaactcatccttttttatggctgcatagtattccatggtgtatatgtgccacatttttttaatccagtctatcattgatggacatttgggttgggtccaagtctttgctattgtgaatagtgccgcagtaaacatatgtgtgcatgtgtctttatagcagcatgatttataatcctttatatacctggtaatgggatggctgggtcaaatggtatttctagttctagatccttgaggaatcaccacactgacttccacaatggttgaactagtttacagtcccaccaacagtgtaaaagtgttcctatttctccacatcctctccagcacctgttgtttcctgacttttt

SEQ ID NO: 1187 - DNA, 1979 bp, Homo sapiens
acgccattttggccccagcggtgcttctaggaagtagaacgccggctcgcatgcctgcccgcccgccagcctgccgggtacggccttttccgccggggcttccaggtcaaagaattcgcctttgccgctaccgctttcttaccctccgcacccgttaagttctccggtcgggcggcagtctctgaacacttagccgcgccatccggggtcacaccgcctggaaggaggtgacgggggcggcgcggggcgcggacactccccgctgagagtccgcctgccatggactcggaatattacagcggcgaccagtcagatgatggtggtgctaccccagtacagaatgactccttccattcagacagccatatggacagaaaaaagtttcacagttctgatagtgaggaggaagaacacaaaaagcaaaaaatggacagtgatgaagatgaaaaagagggtgaggaggagaaagtagcgaagagaaaagctgctgtgctttctgatagtgaagatgaagagaaagcatcagcaaagaagagtcgtgttgtctctgatgcagatgactctgacagtgatgctgtatcagacaagtcaggcaaaagagagaagaccatagcatctgacagtgaggaagaagctgggaaagaattgtctgataagaaaaatgaagagaaggatctgtttgggagtgacagtgagtcaggcaatgaagaagaaaatcttattgcagacatatttggagaatctggtgatgaagaggaagaagaatttacaggttttaaccaagaagatctggaagaagaaaaaggtgaaacacaggtaaaagaagcagaagattcagattctgatgataacataaagagaggaaaacatatggactttctgtcagattttgagatgatgttgcagcgaaaaaagagcatgagtggcaagcgcagacggaaccgcgatggtggcacctttattagtgatgcagacgacgtcgtgagtgccatgatcgtcaagatgaatgaagctgctgaggaagacagacagttgaacaatcaaaaaaagccagcactgaaaaaattaactttactgcctgctgtagttatgcaccttaagaagcaggaccttaaagaaacattcattgacagtggtgtgatgtctgccatcaaagaatggctctcacctctaccagataggagtttgcctgcactcaagatccgggaggagctgctgaagatcctgcaagagctgcctagtgtgagccaggagaccctgaagcatagtgggattggacgagcagtgatgtatctctataaacaccccaaggagtcaaggtctaacaaggacatggcagggaaattaatcaatgagtggtctaggcctatatttggtcttacctcaaactacaaaggaatgacaagagaagaaagggagcagagagatctagaacagatgcctcaacgacgaagaatgaacagcactggtggtcagacacccagaagagacctggaaaaggtgctgacaggagaggagaaggctcttagacctggagatcctggattctgtgcccgtgcaagggtcccaatgccttcaaacaaggactatgttgtcaggcccaaatggaatgtggaaatggagtcatccaggtttcaggcgacctccaagaagggtatcagtcgactggataaacagatgagaaagttcacagatataaggaaaaaaagcagatctgcacacgcagtgaaaatcagcattgagggcaacaaaatgccattgtgaccttgcctggaatgtgtccccatctctactctaagaaatgcgcaatggactctttggagaaagaagatattttaaaacatttttagtgtgtctgtaaatggttcagcgtgtatcagatgttgtcataggactcacatttctcccagttatatttaaaaccgttgtgtactttgtacaaaggaatactagtcatacttctataaactttacacaat

SEQ ID NO: 1188 - DNA, 2315 bp, Homo sapiens
atttgtaatgtacccaagaggacttcattgttaggtacctcctaccccacgggctggggttgggtgttgcggtgaaattccaggggtgaaatatgagagctggggtttctccaccactccactcaccttccagccttcctggcggagctggccatgagcaccagctgcatgcacagtgttgtggcaggtgctctgaggaattcagagggagcagaaggcctagctctgccagttgaacttattgttaaagaaggagttgaagaaaacagttatttacataaaagatataacaacccgagtggatagctaagctctatggggcagtgattggggggtgttgtgtgttcatttgcatggaaaattaaagacatacaagaataatgtgtgctctgggcacaatattagattctaatatgagagggtaatgaatttggttaattgctatatgccagttaatttccgttgcctaactattcccaaataagcattagctttgggatctgtgggctagcagtttgggcttggttcagccggatgattttctgggctctgttgtgctcactcactcgtgtcgatagtgagccagcaggttgtctgcgggctggctggtggcctcagctgggctgttcagctctcctccatgtggtctctcatcgtccagcaggctagcccgggcttgtgcatgggagagttctgagagggtgtggaacatgtaagtcctcttgaggctatgcccaggactggcacaaggccatttttcctcccttttactggtaaaagcaagtcacaaggctgaaaattccggcagtgtaggcatggtcatcattctttgacggaaaatactgcaaagtcacatgtcaagggaataattgcagccacatttacaaacactctacctcatgatacctgtactttgcagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgatctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgc

SEQ ID NO: 1189 - DNA, 2896 bp, Homo sapiens
agcataaagcgaggcaaggtccagctattccacccggcatacaagcttatggagcagccccctttgaagatctccaggtggacttcacagagatgtcaaagtgtagagatgatcgagtgtggatcaaggactggaaagttgcctgtttgtgtccacggtggaaaggaccccagattgtcgtcctgagcactcccaccgctgtgaaggtggaaggaatcccagcctggatccaacacagccatataaaacctgcagcgcctgaaacctgggaggcaagaccaagcccagataacccttgcagagtgaccctgaagaagatgacaagccctgctccagtcacccggaagctgactagtccaagcacggccgaagcctgaggaagctcatcatgagattcatttttcttaaattttggacttatacagtaagggcttcaactgaccttactcaaactggggactgttcccagtgtattcatcaggtcaccgaagcaggacagcaaattaaaacaatctttctgttctatagttattatgaatgtatggaaacaataagagaaacttgtttgtataatgccactcagtacaaagtatgtagcccgagaaatgaccgacctgatgtgtgttataacccatctgagccccctgcaccaccgtttttgaaataagaataagaactggccttttcctaggtgatacaagtaaaataataactagaacagaagaaaaagaaatccccaagcaaataactttaagatttgatgcttgtgcagccattaatagtaaaaagctagaaataggatgtggttctcttaactgagaaaggagctaaagagtagaaataaatgtttgtcatgagtcaggggtttgtaaaaattgtgcctattggccatgtgttatttaggctacttaaaaaaagaacaaaaaggacccggtttatcttcagaagggggaagccaacccctcctgtgctgccggtcactgtaacccactagaactaataattaccaatcccctagatccccattggaaaaagggagaacgtgtaaccctggggatcaataggacagggttaaaccctcaagttgtcattttaattagaggggaggtccacaagtgctctcccaaaccagtatttcaaaccttttatgaggagctgaatctgccagcaccagaacttctgaaaaagacaaaaaaattgtttctccaattagcagaaaatgtaattttcttacttaatgttacttcttgttatgtacgcggagaaaccactatcggagacagatggccttgggaagcacgagagttggtgcctactgatccagctcctgatataattccagtttagaaggccgaagctagcaacttctaggtcctaaaaacctcaattattagacaatactgtatagctagagaagggaaagactttatcatccctgtaggaaagcctaattgtataggacagaagttgtataacagcacaacaaagacaattacttagtaggacctaaaccacactgaaaagaatccatttagtaaattttctaaattaaaaactgcttaggctcatccagaatctcatcaggactggacagttccctctggactatactagatatgtaggcacagagcttactttcggttacctaataaatgggcagacagttgtgttattggcactattaagccatcctttttcttattacccataaaaatgggtgagctgctaggtttctctgtctacgcctcccgagaaaagaaaggcatagttataggaaactggaaagataatgagtggccccgtgaaaggatcattcagtattatgggcctgccacatgggcacaagatggctcatggggataccgaacccatctacatgctcaattggatcatacggttgcaggccatcttagaaataatttctaatgaaactggcagagctttgactgttttagcttggcaagaaacccaaatgaggaatgctatctatcagaatagactggccttagactacttgctagtagctgaaggaggagtttgtagaaaatttaacttaaccaattgctgcctacaaataaatgatcaaggacaggtggttaaaaacatagtcagggacatgacaaaggtggcacatgtgcctgtacaggtttggcacgagtttaatcctgagtctttatttgaaaaatggtttccagctataagaggatttaaaaccctcattgtaggtgtattgctagtgataggaacttgcttgctgctcccctgtgtattacccttgctttttcaaatgatcaaaggttttgtagctactttggttcatcagaaaacttcagcacacgtgtgttatataaatcagtatcgctctatctcacaaatagactcaaaaagtaaagatgagagtgagaactcccactaaaaagtgaaaatgctcaaaggggggaaataaggtatgagaccaccacttctcctgttgtccttcccagtttctccccaacctccccttttccctagtttgtaagacagcaaaaaagggagaaagcaaaaagttggaaaaaacagaagtaaaataaatagctagacgaccttggcgccaccacctggccctggtggttaaaataacaataatattaacccctgaccaaaactacctgtgttatctgtaaatcccagacattgtatgagaaagcactgtaaaaactttttgttctgttagctgatgtttgtagcccccagtcacgttcctcaggcttacttgatctattatgactttttcacgtagaccctttagagttgtaagcccttaaaagggctaggaatttctttttccgggagctcggctcttaggacaccagtctgccaacgctcctggctgaataaaaaaacctcttccttcttt

SEQ ID NO: 1190 - DNA, 2316 bp, Homo sapiens
atgtttcactggctgcagtggcagccatgacacgctgggctccagggagagtcctgatcgcagccccagccagaccccactcctggggttcacaaggttgcaaggcacacttcccctggcctctccgactgtaggcagaggcagaccccacacaaccagagcacgttgctggcggctggtttgcagcatcctgtctaaagccaggggtctgaccctggtgtcagttcaggcccatgggccctgcgacctctcagcctgtgtcgcagtgatccccagcatgggacagcagaggaaggaggggatggccgtttgtttcccttgtggctgtttggaggcgagattgtccgacgttccagactcctgttcagcactcgctcctggctccagagggtgcacacgggcatgcggggccacagctcatcagtcagggggagggggcccctcctgcacagccgggacacccggtgtctcgtgcccatccgctctagccctgccctgcctcctgttccgggtccatgtgttggagctgacggctgatgtgttttctctccatgtccagctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagcgccgatgtggaagtggccagattctgagccgcctgactagagttagaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccaggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgc

SEQ ID NO: 1191 - DNA, 2148 bp, Homo sapiens
caaattgagagcaaataaggactaatacatggtgaacagttaattggaagatcctactgggtccttccacctggggtggaagacatcaaagtggctatcctgatttaagatctagtgtctggctgggtgtggtggctcaaacctgtagtcccagctacttagtatgccaaggcaggaaggttgcttgaacccaggagttggaggccagcctgggcgtcatagggagaccctgtccctaaaacaaataaatttaaaaaaaaaatctggtgtctgttttggccactttgccaatctgctagggaaccttagggcaagggtagatattaactgctctcccgtcggtaccttctgggccttgattaacaaagtcagtgctgaatgcatatgtatttgtgcttccctcttacattcccgtctgccagacataacatatcatgaccatggtggtgttctcttcccattttttgaattttttttttttcgttttgctgcttgttttcttgctgtgttcctttttgacctttctccctccccacaacctggcttgtgccatccccgtgactatcactaacagccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttctcacttttgggaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaccctcag

SEQ ID NO: 1192 - DNA, 2313 bp, Homo sapiens
ttcatcccagggccaatcgatccattccgtgagaaaactgttcatgaaggaccagtgtgtggccaagtcctccctggagggagcctcagcccccaggatcctcccagcctggccatacggggtagactgcagccctgaccggctcggtggggcgcagggagcctcgcggtgcagcctgcgttccggttggggtgtccgctcttcccccgaggggcctcccagcgtctttgaaaggagctggagcgacgctcagaggtgaggagcttggtctgggtagcaaggaggctctgatttcctgtctccactcagcagcagcgtgactttgggcaaattgctgatctgtgagctcgtgtcttcctggctgcaaagcaggaggaatgatggcgctgccgctgcggttgtgcaaatgaaggagcccagcgtctgcagagcggcctgctcaacgcctgccggtgacctgagaagtggcttgtcatttcctccccagtcaggccctcctgcgggaggggtgccggggctctgatggctgtacacgtgcctgggtttctgtagaggatagagagaggagaggcagggaggcttgcctgggagtctgctaccaaaaccatggaattctgtctcggggaggcaccttgcaataaagaagcagcctccacaggccccctgggaagtcacccccatggctgtgtctggagatgagctctgggcgcggggtgcagcctgggagggccagtgtgccccccacctagggtggtcctgcagcctttgccttctattgcggatggtggcgggttggccgagctttggggaccagtttcctccaaagttactatggccccaaggctctggggacaggggcaggtggttctgggcgtggacagagcttgctccttgagctggaaaccctggctaacgagcgagcagaggccctgggaccaccaggggctgtcgagctgcactctccaggctgccagaggcttccattaggcacactggtgtttgattttgtttccttggaagacctggagtttttgtcggttctgagtcatttttcttgatccgcgctgccagttccatgaagaaaatcactttcaaacagatgtggaggaaagtgcacctcctcacttgtccagacccggcctgaattcacatggaaaggtaatcatttcccgccatgagctcactgagagtctgacagcactgtgaggggaggtggccagccaggcacccagcctgagccgtgaccagaggtccgagccagagatgcagccttgggatctcagcctgcggcgctggccctggggccacactcagcatgggggacgccaggctggagcagacgccagacccaaacagccgctctgcccccggggactttggcaaggctgctgcctacgtgaaatgatggaaaggtctaggctggccccaggtcctttctggcatggcctcaggatcttggcaggaggataacaatgccaggagggggtgggctgagtcatgtgcctcctctcaggggcctggctgcagtggtcaggggcagggtggctcattttgcgggcaccggtgccctgcacctggaggaggaccagcaacaggactagccaggtggccgcaggcccttaggacacaggggaggcccaggatttatgggaaggaaggagcagagcacctgagtctggggacatctcgggacaggcactgcccccagcagcctcagcttccccccataaaagggacagacgctgccccatgcctttagctccatcactgtccagggacagggactaaaccctagaccccttatccccaaggagtcttggactgcaggtccagctctgcagaggggctgcagggagcatccagggcccatactcgtctgctcatctctcagtctctgtgtttatggaacaccaggggatgccagtgctgtgccaggaggggcggtcggtgctgagtgaggcctgcttcccaaatcaggcacattcttatgagactaagatttgtccctgctcatggacattaaaaaaatgtcaaagacagcaggattaagcggaatcacagtgtcctgcccccagtccctaacagaatagaaaggaaaaactagaaaaataatcccagcagaaaacaaacaaggccatacactttgaaaatttgtagccaaagaccaggtgtagtggctcacgcctgtaatcccaacactttgggaggctgaggcgggaggatcacttgagcccaggaaattggggctgcagtgagctctgattgcgccactgcactccatccagcctgtgtggcactgtgagaccccatctc

SEQ ID NO: 1193 - DNA, 2429 bp, Homo sapiens
cttgccctcacctccgaatcctgacaacttcccggtcatcccgacccagcgttttccttgggattccgacctccccctcagagaagacaggaggtcgggaaggacctgcagcccaggggcttccaagatgaggcccagagactcggattatcaatgcagagaaatctgaattcaatgaggatcaagccgcctgtgggaagctgtgcatccggagatgtgagtttggggctgaagaagagtggctgaccctgtgcccagaggagttcctgacaggccattactgggcactgttcgatgggcacggcggtcctgcagcagccatcttggctgccaacaccctgcactcctgcttgcgccggcagctggaggccgtggtggaaggcttggtggccactcagccccccatgcacctcaatggccgctgcatctgccccagtgaccctcagtttgtggaggaaaagggcatcagggcagaagacttggtgatcggggcattggagagtgcctttcaggaatgtgatgaggtgatcgggcgggagctggaggcctcaggccagatgggcggctgcacagccctggtggctgtgtccctgcagggaaagctgtacatggccaatgctggggatagcagggccatcttggtgcggagagatgagatacggccactgagcttcgagttcaccccagagactgagcggcagcggatccagcagctggcctttgtctatcctgagcttctggctggtgagttcacccgactggagttccctcggcggctgaagggggatgacttgggacagaaggttttgttcagggatcaccacatgagtggctggagctacaaacgtgtggagaaatcggatctcaagtacccactgatccatggacagggtaggcaggctcggttactaggaacactggctgtctcccggggcctgggagaccatcagctcagagtcctggacacaaacatccagctcaagcccttcttgctctctgtgccacaggtgactgtgctggatgtggaccagctggagctacaggaggatgatgtggttgtcatggcaactgatggactctgggatgtactgtccaacgagcaggtggcatggctggtgcggagcttcctccctgggaaccaagaggacccacacaggtactgtagctgctggggacctgcctgggcctgggttggtgccagcagcaagcccaagtagttatggctgagaagacagagcactgacaatgagctggcagctggccaggatcagggctgtctcaagcttcttggaggaggcagggagaccgtgggttccgaaaatccctggatttagactctcatggtccagcccgtggccctcccagacttgctgcttgcttggtccacagtcggactgcattgcttgggtccccatgtccagccttgtgcagtgagttctcctaaggtctggccttgcccctttgctctgcccctgaagtctatctgcaggatggtcttcacaggttcccaaagctggcccagatgctgatacacagcacacagggaaaggaagacagtctcacagaggaagggcaggtgtcctacgatgacgtctctgtgttcgtgattcccttgcacagtcagggccaagagagcagtgaccactgaggattcagacactgtatcccagaactgctctagtgcccgggtgtggtctgggcatccctccagtgtgaccaagagcaaatcctgcctgccctatccctagccaccgcccagtgctctcactatccacctcaacacacatccatctcaagaggaacatttataccaggcagtcagagctggaagtgtatggagagcccagcccaccaggtcctgccttttgcggtgataaccttctctggcagagtgactttacaacttaactaggaaacccatgtgaggctcctcagacaggatcttgaacagcccaaagtatcattctcagataggggcacccaagctaagggtattagccaaagatgccaggatgggtagctagcccatgtttagatccaggtctccaattcatggttatcagggcatgtgttcaacaacccccaaagtccacgcaggtggcttgtagaaacctttgggcagcctcatgtctgctaaaacagccatcttcaagacagcccctgaaaagagaccagttcaggtcctgccctgctgttctttgctggagatgaggaacaggtgctggggctaaagtttggggtagagcacaagggacaagaggaactcttggagttggctgggtgagagggctctccatttgctacctgtagtagcctgcctcttaactggttgcttctccctagttccagccctgccctggtctgatgccccaacactgcccttgctttgttttccctgtcacctccctattattaaatgttttctacag

SEQ ID NO: 1194 - DNA, 2267 bp, Homo sapiens
tcagtcggggagtggaaggagatgtggggtgggggtgagaaaatgcttctgcctgttgttcttgaaggatagactatgggtgggcagagagaactgggggcagaaatggaattagatgtgattgggttatgcagtcaactagaggtctccttcccgccctctctccacacagagaggaacctctgctccttagctcttacagcaggactgtggcatctagtcacttcaatactagttcttgctcttcacagaggtagatttttctttaccctacagcactgttgggcatccctcccatcacatgggtctgtgggtgagatatgttatgctgttcctccctcgggaaggttggtattgaggggtgccttgctccagaggcgccagcccagcatctgtggtgagttggctaagattcagagtgacctgctcagagctccccagaggccttcactctttggggcagtctctctagggtcactttctgaatgtaccttctacctaaagtatacaaacacaaagagccagctgagctggttctagtgtgaaagccgtaagtgccacccagcaggcgtttgaaaacaagaaatcattcttctgtggaaggagaatgtgccatctcagctaccctcagtccgccagggagcccagtctgtgtattcatatgaagttgtgaaaaccatgagtgtgtgccatggccatcgtgtctacacacagccactattgttcctgtgggctagtctccagcaaattaaaacactggcatggcctaggaagggcgttgcgagctcctaaatggaaagcttctctgggggtagggagatgaagagccaagatgctggtgaagcaggtgcagtgaggatccaaggcaaggaattgccctgagggaggtggctgcatatggagaaaggcagttctctgtgggcaaggccagcttgcttcaggctgtagagggaatttggtctgaagcaacagggcatgaactgtgactttgagctgccaggttgtcttcatctcagaactttcctatcctggcactctcgttacctttcttctataccttggcctctgtaactgcagtccaaaacaagttacagctgccttaatccactgagattctctatgaggatgtacagaaaagttttcctgtaataattttgcttatatgctaactcttttcatgttagcaaagaatattctatgaattagaatgttactgtggtagatctaaaggagaatgaacagaaggtgctggaggacctgttaaacaatctctggctattaaaaaacatcaagatgagaattaaaggcatatcctgatatacttgcctgcttgcacatgaggctgggagatcccatgcctgttgaagttaactctagccctggcctctattgatcttttgggaatgagggctgatttgaaggtgctgttgcaggatttcatttagctgctgccagttcaagtgacctgtccccagggctgcagctgtatccacctgattgcagtaggtgagggctaacagcagaatttaaagtggaccctgggctgtggagcaaagtgactatccatttggacttttggataatgtggcaggagtcccagctgtttaatttctagtcacattttccagaaagttgttctaagttgagattactgacaagatttctcaagggcaggaccagatatgtgagagacttctagttcagagctgacccctctaagcctctgacacttaaacacgagtcctgctgtccccagcacacaactgcactgaagccttgttcctctcggctggtgtagagctcatctgcatgttgtgtgcagataccagtagcctccctgcttgaataggcctctcctaggctaggcaggtgttcagaggcatgaaggtctgggcaggggaagggcgtcttctgaaatgggagttaccaggtttttaaatgctgctattgttttatttaccatttaaggtcttttctattatatctgagtaactagtcagtttttcttacagtgctcatagcagttgtatttgaattgtattttcagtgaaatttgttttacattgccatttaaaattggcctttaacagcttcccaactggcttatatttttttttaatgaaaacataacccatgaggctcagatgctgttgaagaaataaatggtatgttgctgctgacagtagtgcttgcctattgtaacagcattggttctgctgtagcctcggtgaccatttaagttgaataaatctgtcattttcacccac

SEQ ID NO: 1195 - DNA, 2684 bp, Homo sapiens
gcttccagcggacggcagcgcgcgagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactgtaaggaggcacaccccaaagatcctgattgtgctttataacattcctccccgtggaggccacctggacttccagtctggctccaaacctcattggcgccccataaaaccagcagaactgccctcagggtggctgttaccagacacccagcaccaatctacagacggagtagaaaaaggaggctctatatactgatgttaaaaaacaaaacaaaacaaaaagccctaagggactgaagagatgctgggcctgtccataaagcctgttgccatgataaggccaagcaggggctagcttatctgcacagcaacccagcctttccgtgctgccttgcctcttcaagatgctattcactgaaacctaacttcacccccataacaccagcagggtgggggttacatatgattctcctatggtttcctctcatccctcggcacctcttgttttcctttttcctgggttccttttgttcttcctttacttctccagcttgtgtggccttttggtacaatgaaagacagcactggaaaggaggggaaaccaaacttctcatcctaggtctaacattaaccaactatgccacattctctttgagcttcagttcccaaatttgctacataagattgcaagacttgccaagaatcttgggatttatctttctatgccttgctgacacctaccttggccctcaaacaccacctcacaagaagccaggtgggaagttagggaatcaactccaaaacgctattccttcccaccccactcagctgggctagctgagtggcatccaggacgggggagtgggtgacctgcctcatcactgccacctaacgtccccctggggtggttcagaaagatgctagctctggtagggtccctccggcctcactagagggcgcccctattactctggagtcgacgcagagaatcaggtttcacagcactgcggagagtgtactaggctgtctccagcccagcgaagctcatgaggacgtgcgaccccggcgcggagaagccatgaaaattaatgggaaaaacagtttttaaaaaacaaaagaaaaaaaggtttatttacagatcgccccaggagactttccctggtgcctgcggatgtccgaggcctcgcgccagcagcgctcagtgcccttcctggagctctcctggcccaggcctggcgggcactgcttcccggcctgcgatgtcccaaggcggggaaggagtccagattgggtccccctcacaggttagtggtgatacattttaagtctgggagagcggcctgcttgtgcagtgggtcgccgaggataagaggtgagccccctctctcctggctgcagtccttggcgctttggtccagaagggtgcgaagagcgctgggccgaacatactggagactcaccacggcccctccgaggaagaggcacaggacgcctgtggcggtggggatcgaaagaaaggagggcatgtggagtcagggctatgttgcccaggctggtctcgaactctggcctcaaacgaccttcctgcctcgacctcccaaagtgctgggattacaggcgtgatgcccgggccttcttccatcttttggagcctaccccttgtgttacctcccgccacacacctctaatctgaattacatgaaacacggcaagacaccaaacccttctgagccccccacttttcatctgtaaaatggtcataacagtgcctgtttctgcgaactattgagaggggcaaatagggtaatagatgtgaattcattctgtaaactgg

SEQ ID NO: 1196 - DNA, 2386 bp, Homo sapiens
agaaattctttctccctatgtcccagcctacccccactttaccgaggccaacagccgcctcagaaaccagattcaggagctaacatgccccaggtctcacgaggatcagagactccagaggccagggaaggagatcaaggtagtcaagcgggggtcgtctcagatctggttgtgctcgagctatgcaaatgcctctcatggagatgcgaggacctatctattatgatgaccagggccacatccggagggggcaacagactttcatctatcagcccttttcaaccactgatctactaaactggaaacactctgaaccctgccatcttgctcctggtatcagagagccctgtcgtgcataactgtgtagaagtgttggactcagtttactccagcagacctgatctccgggaccagccttgggcatcagtagactggaagctatatgtggacaggagcagcttcatcaacccacaaggagagagatgtgcgggatatgtggtggaaccctggacactgtcgttgaagccagatcgttgctccaaggcacttcagcccagaaagatgagctcattgctttaatttgggccttagaactcagttaaggccttctacggtcccaggctttctgctgcatacactgaagggccacgaagtacagtcatctggacttggcacctggaatacaaggatggaaagcatcatttctgccagcttcttatggtcctgaggcgagacagtcatgagagaggaaaactgcaatgacttctgaccactgccagcctcgcttcctgcattttcttcttcggcttactcttgccaagttggagttgcctaacttccaagagggtatttgctctttttttttctcactccacaaactcttcccaggtagttcagtccactcccatctaccagtcactatacgccgatgaatgccaatattattatttccagcttagacattgttcttggattgcagatgtgaggtttgacttgtttactagacattgctggctgaggatccctagcataacatggcccaaattcaatttatttccaaagctgtctcatctcctttgttctctgtaatgatgttgctatccattcgatcaacatactcggaaatatcaccccctccttccttcttccaagataagtgagttgctcacgacatgatcatgttttggcagtgtactctgtccattcccgtcacttagtaagaatcatctaggttatgctgaagtatgaagttaatctccaaatttctctggctcagtacagaaaaagtccatttctcccttctgcaatgcacccaatgcaggtctgcagggtctctgctgtgcgttgtccctcagggactcaggctgaagaggcccccttgtcttatctggccacctcctctgcacatggctcaggattttccaggcaaggggttgagcagaggcttttcagtgctgggcctggatgtgacataagatgcttctgctcacagccttgtggtcagaacaagtcacatcatccctcctacttgcaggggtgctgggcagcgtagtcatccacagatcaggagagggagcagaggcaggtgttcccgggctgcagcgatctccactgcactgctgtgggctgaactgtgccctccaccccaccaagcttatatgctgccagcctcaccctccacaccttagaatgtggctgtatctcgacatagggtccttacagaggtagttaagttaaagcagggtcgttagggtgggccctaaggtactctgactggtgtttttatgagaagaggagattaggacttacagggagagacactaggtatgtgagcacacagagaaaagaccatgtgaagacgagaagaaggcaactgtctccaatccagacggagatgccaggcacagcccttctgtcacaaccctcagaaggaaccaaccctgccgacaccttggccttgtacttctggcctccagaaccgcaggaaagtacatttctgttgcttaggccgctcagcctgtggcactttgttacagcttctcacccagtttaggcccttttaattgattgctgggcctttgcagttgtttttgcttctaatatattcatctctcaatttatttctggaggctgccacccgaggggcagaacttcaattgtgtccctaatgggaaaccttgctgggatcatgtggtctacagcacaaggttgctaaagcatcttctgccagaattctgtgagtatctggttaggtgggtctggaatatactgagtttaaaaaagttaaataggtttctttactgcaagatgtttcagagactttaatatgctactctgctgtatgaatctccaggcaggaaatcttataaaatgtgtttctgaaatg

SEQ ID NO: 1197 - DNA, 2203 bp, Homo sapiens
cttctgcagcctcatctctgccattcttcaccttttgtgctccaacccaatctggttttcttctcatgctttgaacaccccaagtctgtctgcttcaggagcttcgtactggctaatcattcaccacagcatactcccatctatacggctggctcttatattatgggtctcagctaaaatgtcatcccttcaaagagaccttcttggaccacccccgccattctctatcctatttctctcttttattttctttgaagcacttacccactttcagaaactatctggcttgctcatgtgtttgtctctagattgtctacttcccctcctagactgtactctccacaagagagcaaagctgtgtctgttgcattcactgttgtcttcccagaagcaagcagcatgctggagaccctcaaatacatgtgaaatgaagggacaccttgtgttatttcacctgtttccacctggttcccaagtggcaagcttgcattgaggttacaaagtggcaaagctgggatatcacatgatgtcaccatgatgctatatgaaatgtaacattaattgagtacctatgtgaccagttctttaattctgtaagtgaactctcaaaaaaccctaggtaagtattatcaactcgaactttaacggatgaggaaactggaattttttaaaaaatgacttaaccaaacatcacagagctgtaaaccaggatttgaatgggtgagctgcactcagccttcatctcaagtcagtttgcctctttctccaagaagccacagttgatcctgaccacatcacatatgagttgcctggattgcagtcattcattcactaagcatcttttaggaggtcacatgccaggcaccgtgttaggtaatgatttctccaagtcacaggagccgtggttctgactttagaaagtttctcatctgatgggagggcaggcaagtaaatcagtaagggtggtccctgtcgggacactggttgagaaatacccaggaacactctgattgagaaatacccaaagtgcaaagtgacagggactagaggcatctccactggaccagagagctctggattcgtcttgagctaagtctctggaggtaggtgtcagctacaaggagaaaagctgtatattttgagatatgggatgcagggccttttagttccataaataagagaactatggtgtgaataccacatgccctgggctgaactaagtgggctctaggggaaggtatactgggcagggagtttggagaactggtttctgtctaatccttctctaactctgtgaccttgaatgcatcatttcccctctgagtctcagattctctttctggctggcatttaatgaaacctaaatattctagaccttctacttgttccataagtgctcagtcctacactcactctcctctggcaccaatatactgattactcattttatgcccagcagagcactgcgtgttttgaaatatacaaatagtgggaagcgaaatctttgttctggatgcagttataatttggaaagcgaggaaataaattataacaaggggaaaaaacagacacagagggattgaaatgcataacaatagagatgaaacacgaagagtgataaatgaagattgagtgtgcacaccttctggaggagccctgattgagtattttaacacagaagtgggtgagagcaaagttgtgtcagagtaagacaatgacaccaagccagatggttatcaaaatccacaggaacaaatgaagagaaccagaaattgcaaataagaaggacagagtaccagagaggagagagaggtacagagaattatggaggtggcttccgttgagtatgcagctaagtaatgattaatgcatacatataagaaactactggatgacagagaaagaaccacaagcaatttaaagaatactactaaagtcatgccgtgtgacttctgaagctagctcctaagaagtccttgcagcttctgcctgcgactcttagaacacttgctttgaaggatgccagatgctgtcttaaaagtctgagcactctgaaaccatcatgctgtgaggaagcccaagctaaccacatgggcaaaaaagatgccctctgactgccaccatttgagacactctaattaagaactgcctcattgagcccatgaggccctgtgaatgataataataaattgtttttaaccac

SEQ ID NO: 1198 - DNA, 2779 bp, Homo sapiens
actcaaggctcctcccaggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatggtcaggatggcgaggggaggggctgctctgggccgggagctgagcagaggagctgagcaggggcgctgacccggtgcccacttgctcctcagctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttggagcatggctgtgctctccttgctgggtgggaagggccctcagctgagaaaggacaattgcggcactgccttctccccatcggggtgcctcgaagccagagagctgcactcaggacccccaggcagccagcctcaggtgccccctctttgatatggagaccctgcctgcctgaggagtggggtcagggaaattcacccgggtgtgtgggcagcaggtgggacctgtccccaaacaggaatcaaacttgcttacctataactgcttacacagccgagggcttatttctctgtcatggaaagcaaacctggagatcgtcagaccagagtgtgtggcagcccacggttcctgggacgccagcctcttctgactctgaggcgttaatcctgagtgcctgtgtggtggcctcctagggctaccttaacaaagcctaccataaactgagtgccttaaaaccagaaacttattctcacagttctggaggctgaaagttaggaatcaaagtgtcaggagagcaatgctctctctgaagtctctaggaaacagtctgttccatgagcctttcctggctactggtggccccaggtgttccttggtttgtgggcagtatgactccaatccctgcctttgtcttcacatgaccttccctcccctcccctccccttttcttttctttcttcttttgagacagagcttcactctgtcgccccggctggagtacagtggcaccatctcggctcactgcaacctctgcctcccaggttcaagcaattctgcatcagcctcccgagtagctgggattacaggcacccgccaccacgcccagttaatttttatatttttagtaggacggggtttcaccatgttggccaggctggtctcgatctcctgacctcaggtaatccacccacctcgatctcccaaagtgctaggattacaggtgtgagccattgcgcctggcccacatgaccttctttcttgtgtttctgtctcttctgattatttttattgtatgtgactcttgtcactcaggctggagtgcaatgacgccatcttggctcactgcaacctctgcctcctgggttcaagtgattctcctgcctcagtctcctgagtagctgggattacaggcatgcgccaccaccctggctaatttttgaagggagccagcccctccacacctgtgagtatttctcatcaggtgggacgagagactgagaaaagaagacacacagacgaagtatagggaaagaacagtgggcccagaggacccagcatacggaggacctgcatcagcaccggcctctgagttcccacagtattgatcattatttttaccatcttagcgaggggagtgtagcagggcaacaagtggggagaaggtcagcgcggaaacatgtgagcaaaggaatctgtatcatgaataagttcaaggaaaggtactgtgcccggatgtgcacgtaggctaaatttatgtttctctttacccaaacatgtcattgtagcaaagagtaacagagcagcagcgctagatttatgtttctctttacccaaacatctcagtgtaggaaagagtaacagagcagtattgctgccagcattcttgcttccaggcagttttctcctatctcagaatagaacaaaagggaatggttggctttacaatgagacattccattcccaaagacgagcaggagacagaaggcttcctcttatctcaactgcaaagaggcctccctctttacgactcctcagcacagaccctttatgggtgttgggctgggggacggtaaggtctttcctttcccatgaggccatatctcaggctgtctcagtggggggaaaccttggacaattcccaggctttcttgggcagaggtccctgcggcttcccgcagtgcattgtgtccctggttaatcgagaatgaagaatggcgataacttttaccaagcatactgcctacaaacatattaacaaggcacatcctgcatagccctaaatccattaaactttgattcattac

SEQ ID NO: 1199 - DNA, 2578 bp, Homo sapiens
tttttctttatatagaatatttgaattagttttatcctctttctgctgtgagtagaacagttgaatcttacttgagttattgaaatgacaggtgtgatttaaatagcatttgaagaaaggttttcagggagatgtatctacgttaactttcccctatggggtgatagttaactgttgctccaaagatgacctgtgagttcctatttttgaatattatcgtgaactcgtggattaaaacaaactgtgtttcaatttattgcagttgttatccttttgttttgagacggagttttgctcttgttgcccaagctggagtgcaatggcacgatctcagctcactgcgacctccacctcctgagttcaagtgattctcctgcgcagcctccagagtagctgggattacaggcgcccaccaccatacctggctaatttttttgtatttttagtagagaccgggtttcaccgtgttggccaggctggtctcaaactcctgaactcaggtgatcctcctgtctcggcctcccaaagtgctgggattacaggagtgagccactgcgtccagcctgttatccttctcgatgtttaaattttctatctttgtccagtggaaacctattcaaggtgacctccgagtagttttgacacgactcttaactagtcactgataccctccttgctttttggtatgacaacatgttcccttcttatcttgaacattttatgctccagatttggaattagcccattttgctaaggaattatagttcctttagttggggcatagtatttagagaccacaatctgagcactgaggattcctattgctactaacttactcataccttttaggccttttcagtgaacagacttagacgcatgtctttttttttttctttttttaaaacataaattacatagtaattcatactgatacttggcaattcaagttcaggactacaaggtttttacttaatatcattcttatatctgtctgtatcttctttttcccatgcccaaactgctgatgctcaacataatttttttatttgctttatcccatgatataaatacagcactcttagaataacaacactgccatcaatattactagaaatgctaactctttttttgttgttgtctgttattgaaatacagcaatgtgtcgcttaatgcctctgagaaatgcctctttaggtgatgtcatcattgtgtgaacaacagagtttgcttacacaaacacagacagtatagcctactatatacatctgggctttatgtagcttgtaggctacagcatgttattgcactgaattctgtaggcaggtataacacaatggtaagtgtttgtgtttccgaacatacctaaacatagaaaaagcaaggaacggtggctcacatgtgtggtcccggcattttgggagggtgaggcaggagaatctttcgagcccatgagtttgagaccagtttgggcaacatggggagaccccatctctgtaaaaaatcttaccaaaaaaaaaaaaggtgcagtaaaaattcagttttattatattatgggaccaccatcatctgtgtggtccatctgttgactgaaacgtcatcatggcggcatatgactgtattcgtatacctagagattttctttgttcttagtgtatattttgttatgaatgtgcctttactatgctttaaagtcactcagaataattcctctctgtggtttttgtcaccaactggttacacagtgaggtgcttttgtttcatcttattttggagttttgggggggatatataaaaaaaagttaatcattttataattatgaagtgtagttccaaagtcaaatctacaaaacaaggcataaagaagttaatgttttgttatttaacttgtaaacagtgaactctgtagagaatgcagattattttagcgttttatcttctttcagtatgtttaaatagaaacagatactcagttgtatatcagtgctttggtaactttttaatgctctggattcctagatttaataataagaggaggacaggtgtttgaaaaaaaaaggctacttgctgtttttcctcaacagccctttggcttgctaattttgtatattgttacctttttttccccgtctataacttttctttatccttcttcactgatagatgttcattcatgaaactgatagttcttaaatgtattggtgtaaataactttacttctggctcacatttgaagaaatatcattccttcactggaaggaattagtaacagtttggctttgttagcttgtgcttaaggtaaggttttagatgttcctatggtttgacagcttctgaaatataataatacctaagtggatcacctgaggtcaggagttcgagactagcctggccggcacggtgaaacaccgtctctactgaaaatacagaaattagctgggtgtggaggtgtatgcctgtagtcccagctacttaggaggctgaggcaggagaactgcttggacccaggaggaggaggtcacagtgagccaagatcacgccactgtactccagcctgggtgacagagtaggactccatctc

SEQ ID NO: 1200 - DNA, 2247 bp, Homo sapiens
gtttgcatgctagcggccgctcccagtggtggtcaccgccagtgccaatcccttgcgccgccgtgcagtcccgccctctgtcgctgcagccgccgcgcccgctccagtgcccccaattcgcgctcgggagtgaggagccgccaacaccccagctccgctgctgccgccaccgcagtgctctctagtcgccattggttacctaaactttccagtacccgcgacctttccgggactccgcggcggcggggcagaggcggcccaggggcggcacgcggctgctccggtgcgccgggctcttttcggccgccgcacggccgggcctcacaggctgccctcctgagagaggctcagaacacggccaggtacgcgccgccgccacagttgcgctgctagcgacgaggtgagtgctaggtgtttggtgggccgggcgcggggtccgcaaacttttgcgtacggcgctgactccctgcggtcctgccggcggctccggccgtccagacgctccgctcgccacgaactcctggagacgcagggccccagctgttaccgcagcacttggactagggtgcggagcgctccctggactcaacaataccgggaggtttccgctcccccaaagtgcgtgcgcgccgtgtggggagtgtacggaggttggcgggagacgctcctttggggaagggggaggcggctgctaagtttaggaaagtactcggtttcttcctggtgcccctttgtttgccgctcttgggatctgctgggcccagcgccactgctggtgggcggaaggggcaggtggcgggatttttcacgccccggtggaggggagtccctttcatccacgggactcgggccggcctgccccgacctgggtggaagcgcagtcgcgcagagcggggcgaccggctggctaggcggctcgggcccgcggcgtctgctcagtttctgagtcgcaaaaccgtcaaggaattcggaagctcccctcccccgcccatctctctggccccagcgcgcagtcaagtctgggggcaaccccccccgcgcccccggtctgtttggggtctgcagagcggcgccagggtaaagcgcagacctgttgatcctaggttctggcgggtcggggtctggcagatcctgggtccggccttgcttcccagtggtaccttctctcacggagggggcggggccgtccgctttcgggagtcagtgatcgccggatatgtgacaactgtgggtcgttggagtcccgccggcgctgggctagggcctggacttcacgtacatcgactgtgcgtggtcatgccgggggcaggggctcactcattgcaccgacctcatgttgctgtagcaagctaagtgcgtcgaaaattccacaaagttagggaccgatgtgattattttcgaatcggtggtgttctggagcaaaacctagtaagaaacaaaatcccaccctctgttttatttgcaactgttttgcatggtcatgagtggcttgacctgccttctaggtgttttcctctgctggcacgccagaatccctggttcagcctggaaggcgaggggcaggactccccagacagtggcctcagtgtggtaagtggctcttgacaattttatgaaaaatttagaagtccttcctagaaaaggtgcaattaggaaaaataaaatacaggaaaatgttgagtatgatgcgtttattttaaagagtaatcatgtctcacatatgctacagatttttgtggaaagccgccgagctgggtaactgacacaacaaaagttgttcatcactggatccatttattaaaaggggaccttaaggcgattgcaggcctagtagaacacacacctgtagggcaaaaatggaaatttatggtgtagttctgccaccctggctccctcactcccaggcatttggcccctttactgggctccgaggagtcctctgctagcagttttaaagaggaaactgggccgggcgtagtggctcacacctgtaatcccagaactttggcaggccaaggcgagtggatcacctgcagtcaggagttcaagaccagcatggccaacatgctgaaaccgcgtctttactgaaaatacaaaagttagcagggatgatgccaggtgcctgtaatcccagctacttgggaggctgaggcaggagaatcgcttgaacctgggaggtggaggttgcagtgagctgctttcgcactatggcactgcagcctgggagacaaagcaagactctgtctc

SEQ ID NO: 1201 - DNA, 2920 bp, Homo sapiens
gagtcatctgatagctcatcaagctctgaagatgagtgggttgaggctgttccatcccagactcctgacaaggaaaaagcctggaaagtgaaagatgaaaagtcaggaaaagatgacacccaaattatcaagagggatgagtggatgactgttgattttatgtctgttaaaactgtgtcatcatcatcactcaaagctgaaaaggaaactatgaggaaaatagagcaagagaaaaaccaagcgcttgaacagtccaaactgatggaaagagaattgaatccgtactggaaggatggtgggacaggtcttccacctgaagactgtagtgtgtcatcgattactaaagtttcagtggtagaagatggtggattaagctggctaaggaaatcttatctaagaatgaaggaacaagctgagaaacaaagtagaaactttgaggacattgtagccgaaagatatgggtcaatggaaatatttcagtcaaaattagaagatgctgaaaaagctgcatccacgaaagaagattatagacgggaacggtggaggaaacccacatattcagataaagcacaaaattgtcaagaaagtagagaatcagacttagtaaaatatggtaacagttcaagggatagatatgctacaacagatactgcaaaaaatagcaataatgaaaaatttattggtgatgaaaaagataagagacctgggtctttagaaacgtgtagaagagaatctaacccaaggcaaaatcaagagttttcttttggcaatttgagagctaaattcttgagaccctctgatgatgaagaactgtcatttcacagcaagggcagaaaatttgaaccacttagttcatcttcagcattggtagctcagggctctttgtgtagtggttttagaaaacccaccaagaacagtgaagaaagattaacatcatggagtcgctctgatgggagaggagacaagaaacattcaaatcaaaagccatcggaaaccagtactgatgaacaccaacatgttccagaagacccaagagaaaaatcacaagatgaagtcttgagagatgaccctccaaaaaaagaacatctacgggatacaaagtctacatttgctggcagtccagagcgtgagtccattcacatcctgagtgttgatgagaagaacaagttgggagccaagattatcaaagcagagatgatggggaatatggaattagctgaacaacttaaagttcaacttgaaaaggcaaataaattcaaagaaactataacacagataccaaaaaaatctggggtagagaatgaagaccagcaagaagtaatccttgtcagaacagatcagtctggaagagtatggcctgtgaacacacccggaaagtctctggaatcacaaggaggaagaagaaagagacagatggtttcaacccatgaggaaagagaaagggtcagatactttcatgatgatgataatctaagcctaaatgatttagtcaaaaatgaaaagatgggaacagcagaaaatcaaaacaagctctttatgagaatggcatctaagtttatgggaaaaacagatggagactattacaccctggatgacatgtttgtctccaaagcagctgagagagaacgtcttggtgaagaggaagagaaccaaaggaaaaaagctattgctgagcatcggagtcttgctgcacaaatggaaaaatgtctgtattgttttgacagctctcaatttcccaagcatcttattgttgcaataggtgttaaggtttatttatgtttacccaacgtacggtctcttactgaggggcactgcctgatagtccctttgcagcaccatagagcagctactttgttggatgaagacatctgggaggagatccagatgttcagaaaatcattggtaaagatgtttgaagataaaggattagactgcatttttttggaaactaatatgagcatgaagaaacagtatcacatggtttatgaatgtattcctcttcccaaggaagtgggtgacatggctcccatctattttaagaaagccataatggaatctgatgaagagtggtccatgaacaagaagttgatagatctctcttcaaaagatatcagaaagtctgtacccagagggttaccttacttctctgtggattttggccttcacggagggtttgcccatgtcattgaagatcagcacaaattccctcattactttggaaaggaaatcataggtgggatgctggatatagaaccaagactttggaggaaaggcatccgagaaagctttgaggatcagaggaaaaaagcactgcagtttgctcagtggtggaaaccatatgacttcaccaaaagtaaaaactattgaggtgtaccttccattttaaaatttttcttcagatcccgttcagttttatttccattgcatctaatgaagcaactgaccctcaggtcacaggcagagagaatcacagcagcagactgctctgggtcagtgacaactgtacatcaggagattgtgttgttttcttcttcacctgctcctatctatggacttcattttagtcaccatggagtaaaaacatatattcgatgatctgctcacattcctgctctctacctacttcttggtattccgaattgttcagttaatttagagaaggccttttctgaagggatatctagaaagcataggaaatccttggttcagagggaagtgggtctgcttcatggttgttaagtctactgtctggcttcttttgcatttttaaaaataagacgatttaattttaatttcataggattttatagaaaagctcttaattttctactagcagtatatagtatcacttctattctttttgttaaaggaaaaggaaatgtccccaaagtattaaagaattaaatgatactgaaaattt

SEQ ID NO: 1202 - DNA, 1874 bp, Homo sapiens
actttttactttcccctgctggtgcccaagaccaccgtggaaggaatggctaaaggataaggtggaggagacaagtgagttagaatggggcttgttacccccagaagaattttcccaagtgaatggaatcattcttcaaaagaaaatgtgcgatttctgggataagatctggaacttccaagccaagcctgatgacctgctcattgcttcttaccccaaagcaggaaccacttggacacaggaaattgtagatctgatacaaaatgatggcgatattgagaaaagcaggcgcgcttccattcaacttcaacaccctttcctggagtggataagaatgacacactgtgggattgaccaggctaacacaatgccttccccaaggaccctgaaaactcatcttcctgtacaactactgcctccatccttctgggaggaaaactgtaagtgtccaagagggagaatctgagactcactttcctgaggtcatccaatcccctcccatcttatcaggggtatggtatggcagctgtggcagagggatggaggagaggagacaccagagggaaaaaaaaaaaacgcaaatcctgttcacccaggaggtcaacaatggaaggaatacagaggagaaagcaccaggagggtgtagcaggcataccccgagatgaagaggggtttgggcgaagttggatgtgcaaacaactcaaccccaccatgacatgaaggaggccaccgtgtgagcacagggcctggaacaatgggtgtaatgagttactgccacgtcagagaaattggttgctcctgttgatatggtttgactgtgtccccacccaaatctcatcttgaattgtacttcccataatccccacatgttgtgggacgcacccggtgtcaggtaatggaatcatgggtggttacctccatgctgttctcatcatagtgagttctcatgggatctgatggttttctaaggggcttttcccctttttctcagcacttccttttgctgccatcatgtgaagaaggatatgtttgcttccccttccaccatgattgtaaatttgctgaggcctccccagccatgcggaactgtgagtcagttaaacctcttttctttataaatcactcagtctcaggtatgtccttataggagcctgagaacagactaatacacctgtcaatgccaaaatgatatattttggtggatttaaaattagcaaagccagcctgcccaaccacaaacacctccatctcaggcacatggtactgctttaaataaatatcagtaggacatgaaaggttgggtctgaaaagtcatcacctacctaacttcctcagattcctacctttttttatattaatcttgaagcttgctctccctatctaattttgtatagatttaggaatgttaaagtgtgtggataggctgatgctataggttgcttctaggggaggaatcttccaagagatactgacccctgaccctagtcatagactgttctcacttcacggtaagtcaataaaatgatagctttcctgtttgagggatgcccaaattctttgcaaaatctaattacaagtctgaataggcagtaaaatttgttcttgctatttatataattgtaaactttaactcagaaatggacattataagctgttctcagagtatccaaagatcaggttggcaccaacaggtcccgagtaagtcaggttttcttcacccctccctgtgtccctctggggaccgagcacgtccagggagcaaggagcagaccagtcagcaaaatgtaaaacctgtcttaacctggaaggtggggctgtcttatccacatttggctccacctctgagctaacttctgattaaagctgatctaagg

SEQ ID NO: 1203 - DNA, 2831 bp, Homo sapiens
ggatgttgtttagagttcttctgttagcacagctgtttctagggtctggaaaaactctaaggacccccaggaggatacacaccagattgggtctgggctcacaccaccctgcatccccagagcctccctggacgctgtttgcaaggtcctcaccgcctggaagtccaggagccatttttagggaacagcattcaagctcaacacggcaagttccctctttcctgcaggggaggaccagaagggagccggagatgggggagaagggtgggaggtggatggtttggaaaagggatggagacccagacggagagaagccagccagccagggtgagggaacaagctgctgtgctgcccaggagaggcctggcctcaggctgccaccctcagggaggtagatgcggctgtgacagcagcaaagaatgacggccaagggcgacagcaggggctggccatgctgtaaaggggcttcttgggagggtccagcctcaggaatcaaggggaactcctgagccgagaattctgaagatctcctccccccctgaagctgtgggctgggccgtcggaaaactttcagttttgtttccttgcctgcaagaaacgaaactcaaccgaaagcctgcagagagcagaacatggaaggagacttctcggtgtgcaggaactgtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggcttatggatctggcataggcaagaggttctggtttcaggaaagactggctgttctcttgagatctgtaaagagaggatgtgaaaaaggaaggtcctggaaggcagtcagatggagccctgtttcccgcctttccatgtccattcctcctggggcccctgatctgtctctctggagatactcaagctcaggcagccgttgccaactcagactggtctgacaaacacttcttgaacactgggcggggtgctagagagacactgaggtagccacatcggatccctgccctctgggagttcacagacccaaacccggaacactgtgagccaaagtggatgtggggcaggccctgggtgctgggtggacccacatctggtgtgtgtgtgtgtgtgtgtgtgtgtgtttaggttgggtgtacgatgtgtcagcagagcatgcagaagtcctcgctggggtttcataaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcggagtgaacaggcccagctcgggaaaggggaaagaatttcagctcctgaaagggaaatctactgtcattattgcaaccaaatgattccagaaaataagtatttccaccatatgggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggtactcagcctctgttctctgcttacctttctgggaaccatccgcacagtgtcttaaaaaaatccaagacctgaaagatgttcacaaatgttgtggctgaaaaggccgttttctctgactcccacttctctgggtgcccaaatgcactatctcgtagcacttaccacctggtttatttgcatcacctccgagagactgagtcacctttgactcaagccaggtctttgaaggtagagccaggtccctcttctctgtgtctccagcttctaggccagggattgatttggagcaactgcttcaaaactgttgagtaaatgaatgaatcagaggatacccagtctatctctctcatggtgtagatatggcactgaggcccagagatgagatgtcttggtcaagatcctaagccagttggtggtggcttacctccagcagatcaaggtttgcttcaagaagatcagggtttgtaggcatctccctgaatatcatgatttttatgtcctaggttattttctagtaataataataactggcattagaggttgttaaccattgtgtgccagttacaatacagagctctttataatcttcatcataaacaataggcatgcattttatctccattttacagataaggtgaagtagctttccaaggagtatacaattagaaggtggcaggatccagcctgagtccacatgtatatagctccaaagtttatgctcttaagctccagattaaatgccttacttaaaaaatttattttttttcaaaatacataagtactagattttgttggagctagttgatataatatcatataaagaagtataaaagcaaagctaaccctaattccccaaccccataccctgagataccactttggacagtcttatgggcatcttttcaaagctctacctttgcatatacaagcctaaacaagcat

SEQ ID NO: 1204 - DNA, 2680 bp, Homo sapiens
agttgcgccgctaccggccgtggggcgggcccggggcgggcaagatggcggcggcggccgggcaagatggcggcggcggcggcggggccgacgaggacgacgatggcgaggatggggatgaaggggaggaggaagaggaggcttgccccgagccctcaccgctgtgccccgtccccgctggcggggggttttacctggtccccacattttcgctgccgcccgcgccgggccgtctggagcgcttggggcgcgtcatggtggagctggaggcgctgctgccgcctcccggagcggtccccgggggtgccggggtgtgggtgcctgggggccgcccgccggtgctgcgcgggttggtacgcgtgctgaaccgctccttcgagaaggcggtgcacgtgcgggcctcacacgacggctgggcttccttttgcgaccacccagcgcgctacgtcccgcgcagcccgccgtgggcaggagcgggaggaacaggagcaggagatcccatcctggatccggggctcggcctgggtcccggccaggcatccgcctcctcgcccgacgacggcggccgcaccgaccgctttgccttccagctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggcctgccgaggaggaactgaagacgaagaacatggatgataacacctttgccatggcagagcatcctgatgtccaggagtcagtgggtccactggtagcccccacccctctccgtccatggccccatatgacacttcaggtttctgacgttccgatgactggcaaccccgcagaagaaggtgatgtccccagaagcagtccacctgtggcttttacagaggtcctccaggcaccggccatcaggattcccccctcctcccctctctgtggcctgggtggctcccccagagaccaggcctcagggcccgatgcgagcgagggggccaccgggcctttcctggagcccagtcagcagcaggcagaggccacatggggagtatcgagtgagaatggaggggggctggaggctgtgagtgggtcagaggagctgctcggtgaggacaccatcgaccaggagctggagcagctctacctgtctcacctgagccgcctacgggctgctgtggctgcgggtggggcagggggtggtggggagggctccacagatggagggatgtcccccagccatcccctgggcatactgacggaccgcgacctgatcttgaagtggcctggccctgagcgggccctgaacagcgccctggctgaggagatcacgctgcactatgcccggctggggcgtggcgtggagctcatcaaggacaccgaagaccctgatgatgaaggggagggtgaagaggggctctctgtcacaccctccagcccagaaggggacagccccaaggaatcgcctccagaaatcctctccggggcccgttctgtggtagccacgatgggagatgtgtggctcccatgggcagagggctcaggatgtgacggccctgtggttctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctgagaatgctcaactgaaagagaggccttctcatccccaagctctccagtcaacacagggctccctgtggtgacaccagtggagatgagggaacgggtagatggtgtgagtgaggggaacttttagagtggaactgggcatgtcctccgcctaccccccgagcctgtatttatttttgtataattctctggatgagggagagtggtcgtgagctggtcttggggcacaattacccagagatatatttattaacagccaacctgtgcaacctgctggagctttatttttaatttaatttatatagagtacctattattatatgccacaatagagctctatgagaaacagtg

SEQ ID NO: 1205 - DNA, 2262 bp, Homo sapiens
gtagctgggattacagttgcccaccaccatgcccggctaatttttatatttttagtagagacagagtttcaccatgttggccatgctgatctcgaactcctgatctcaggtttccaatacttatctacaggaatcgccatgaccccagctctgagggaggcaacagcaaagggtatcagcttttcatctttgccaagtaccatggagtctgacaagatgctctacatggaaagtcccagaactgtagatgaaaagctaaagggagacaccttttctcagatgcttggatttccaactcctgaacctactcttaatactaattttgtgaatttaaaacattttggctcccctcagtcttcaaaacattaccagactgtttttttaatgagatctaattctacattaaataaacacaatgagaattataaacaaaagaaattaggggagcccagttgcaataagctgaaaaacatactgtataatggcagcaacattcagctcagtaaaatctgtctttctcattctgaagagttcatcaaaaaggagcctctatcagataccacgagccagtgcatgaaagatgtacaaattattctggattcaaatataaccaaagacactaatgtagataaagtacaactacaaaactgtaaatggtatcaagagaatgcacttttggataaagttactgatgctgagattaaaaagggtttattgcactgtactcaaaagaaaattgtacctggccactcaaatgtgcctgttagttcttcagctgctgaaaaagaggaggaagtacatgctcgtttacttcattgtgtaagcaaacagaaaattttacttagccaggctagaagaactcagaaacatttgcagatgctcctggcaaagcatgttgttaagcactatggtcagcagatgaaattgtctatgaaacatcaactccccaaaatgaagacatttcacgaacctaccacaattttgggtaatagtttacctaaatgcactgaaattaagccagaagttaacacattgactgcagagaataaattgtgggatgatgcgaaaaatggctttgcacggtgtacagctgcggaaatccaaagatttgcattttctgctacagggctgttgtctcatgttgaagagggtttggattccgatgcaactgatagcagctctgatgacgatttggatgaatatacccttagaaaaaatgtggcagttaactgtagtactgaatggaagtggcttgtagacagagcacgagttggcagccgatggacttggcttcaagctcagatttcagacctagaatgcaaaatccaacaactaacaggcattcacaggcaaattcgtgcctccaaggggatagtggtcctagaagaatgtcagcttccaaaagatattttgaaaaaacaaatgcaatttgcagaccaagcagcttcactaaacattctagggaatcctcaggttccccaggagtgtcaagatcctgtaccggaacaaggttttgaaatgtcaccaagcagccctactttacttcttcgaaacatcgaaaaacagagtgcacagttgactgagatcatcaacagtttgattgcccctctcaacttgtccccaacttcatcacccctctcttccaaatcctgtagccataaatgtctggctaatggcatttacaggagtgcatcagagaatttagatgagctgtcttcctccagtagctggttacttaaccagaagcacagtaagaaaaagagaaaagacaggacaagactgaaatcttcatccttgactttcatgagtacatcagcccgaacaaggccacttcagagtttccacaaacgaaaactgtacagattgagccctactttttattggactccacagactttgccttcaaaagaaacagcatttttaaacactacacaaatgccttgcctgcaatcaacttcaacttggagtagctatgaacacaattcggagtcttacctattaagagaacatgtatcagagttagattcctctttccattctgttctatcattgccatcagatgtgcctcttcattttcactttgaaacactgttaaaaaagactgaaataaaaggcaatcttgctgaaaataaatttgtagatgaatatatcatatctccatcacctggtatgtcacatttacagttcttgtactctatatgcctttttatgtctttatacttactatttttgcattctaagaaaaataaaatctaagaaaag

SEQ ID NO: 1206 - DNA, 2940 bp, Homo sapiens
agtccgggtttggagactcctgcgtcctccgacttttcatgggccctgacatggcaggtgatatccaggacactgttgggtgccatggagttggggagagttggccagaagagttggataaccttgaattgaatattgtccatgactgtcgcgttgcttctgctgttgcaagctgcctccctttactcccagtcccatttacaaaaataacgcttgtgttttaccagttatagttgtagtacccattcattatagaaaatctggaaaagctagacaattctttttcagtttcagggaatagttcaaacaagttatgtgctgtcagtgccctgcagccaaaaagcacgaggagcatacctgtagtcaagcaaagttgggtttatttccttgttgcattggggtggggaagaactgtgggacatctcagagaagggctgtgggcttgtgttgggtgatttgagagacagttcagagaagtggggctttgctctgtgttggatgctgctgggaagcagggctaattctgtgattgggtctcagtgattcctgacttgaaagcaggaagaatggaaggaggctaaacttctcattggtaaagcagcagctgtaactcctattagccaggataggggatctttggtcatttttgtattttggataatgtttatgtttttgtctgtgtccggacatgatgactgaatggtcctgtttttgtcttgtcgcaagggcacagagtggccttgtctgagggtgatgtgctgtgaaaaactgttgatgttcaatgggaatggtagggccagccgtgggggctaccccagattcagcaaagattctgcccacccttgcacatttccacctctacagttttacctgttcatttcagacatgtttgctctgagtacacatgtgccggataccaatctcactttccaggcctgcgtaaatcagccactgtatccatttctttgagatgtacagagagtcagccatgctatcagggagatggtagtgggatcttgctcttttgggcagcactagtctaggaggtctaattttgcaataacttggttccaaaagtttccatgtctgttgtttagtcctcagaaacaccttctccctacaggaagtgataggagtgcgagctggaatcccattcaacttcataaagcttatttcatctgtgatgcagctgaaaaatgacacttagctagctattgagtggtacatggcaataaggaaatgtaaagagacctgggcagtgctttaggctgttttagggtgcagccagggtgttcatgtatacaggtgctaggcagaaaggaagtgcttataacacaagagttaggggcacccttgtgcctgcagggtcgacaggcagggtcagtgtatgaggctttttgggtgggtcttgggacaaactaggggatgcatggccctctctaggggtcatccaataccccagctctgaccagttgttcccctgctagcccagttggcctctgattttaggagaagccagaagtccagatttttctgtgagctctccttagttgaccacattggaagcaaacttttaaatgctgtgtatgcgtggcccaagcaaaacacatctggaggccagattgaatccacaggctgaaagcagtcaaccaggcctgatgtcatgaccctgtatcctctccactggcaggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaacagaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgtcattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtg

SEQ ID NO: 1207 - DNA, 2181 bp, Homo sapiens
gaaatgactactgtccggggcccgaggtgctgcctcgcacaatgcatcaaaggaggttgtgtccgtggtcgtaacctcttcgcgtgaaaggcaccgcctggtccagtctttgtgaaggaacaaaataagttcacttccttgggcaccgccacccaccctcagcaaatgacaaggctggagcgcagctcccaccgcacagttatttgcaaagtcccaggtgaactcgtggcgagagaaggaaaatgcgcgtcccgggcgcgggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccagatttagatggtgctctactctcggggccagatggtgataggaatgtgaatgcaaatttattggctgaagctggcactagtcaagatggaggtgatgctggtacttcacatgatttcaagtatggtttgatgcctggtccttcaaatgatttcaagtatggattgataccaggtacttcaaatgatttcaagtatggattgataccaggtgcttcaaatgatttcaagtatggattattgccagaatcttggccaaaacaagaaacctgggaaaatggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagt

SEQ ID NO: 1208 - DNA, 2322 bp, Homo sapiens
taccccttcatgctccagtgcaccccaggcttcgtggccagcctgggaaactgtctctaccctggtctcccttcagatcagcttctagaaatgtttcgtggctacagtggcagcactgttttttccatgatgcaagcagtttgccctcttgggcggggttatcagtggctggcagggctggcacagcgtgtccgcccactgccacctgtgggttccaggagggcccagcccctgtgctgatgcccaccaccttctcagctcatgtctggggaagaggactggcagggggaaaggtgcctcctcctgaaaggtgcctcctctgtttttgcctaatataggcttgggaacactttgatgtcagctaattctgactcctttacttactagctgtgcggccttggggcaacttacttagcctctttgagcctcctgttccccatctgtaaaatggaatctcaatagtgtctaatagtaccatgtggagaaacttgtgtgaaatgatagctgtggactactgtacacagtactcaggatgtagtaagtgctcaataaacagctgttggtatggttgacgttatggtagtggttgtggggaggacgtaggaaactggagactagcttggcaaagctggctcttcctccttttagggaaagcttagagcatccccatggggtatacccatactcagactgtcctctggcatcgaggttggcccaggattcggttcagctgtcacagtgaggtggcgggatcagatgtggcaggccatgtcccttggaacttgagtacatcgtgtgatctctggaatgaaaacaggccttcaccagtgttgatggtggaaagcttagggaagtgcttcaaacacagtaggagggacttacgttagattttggaaggacttgcctgattcggaagctccaaagagtggcattacagagctgggtggagagaggggctagccatcttttgtgtcgcccaccgggctcatgtgtcatcgcctctcatgcagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcaggtgggcatctttgggaagtggggcaagggggggatagggaggggggtaacactttgggaacaggtggtcccaggtcgtttcctggctagatttgccttgtctggctcctgcccctgagttgcacaggggaggtatggtggggtcttgccttctgtggagaagatgcttcattcccagcccaggttcccagcaagccccaaccatctccttctccctgatggttgcccatgggctcaggaggggacagatggatgcctgtgtcaggagcccctctctccctctcttggagagagtcctgagtgcccccccttcttgggggctttgtttgggaagctggatgagcctggtccatggagagtttaaaaagtcttttggtgttacctggtaatggggcacatctcagcccagatagggtgggagggagctgtgaaacacagggagggggttgctttcgggtatctactaggagtcagggtgaagcctagagaggatgaaagaaggggaggggatggggagtggtaagaacctaggatttgaattcccagcctggccaacccttgcagccatgtcttggcctcaagtggaacaagggctccttgaggccagcagggttgggggagttggggtgggcctgagcctctttcctgctagagctcttggtcctccctgcctccaccacccatccctgctctgcagaacccctgggtgctgagtggcaggagccccagggttgtcccatctgggtatggctggctgggtcactaacctctgtgatctgcttccttcctttccagattatgcggatcaaacctcaccaaggccagcacataggagagatgagcttcctacagcacaacaaatgtgaatgcaggtgaggatgtagtcacggattcattatcagcaagtggctgcagggtgcctgatctgtgccagggttaagcatgctgtactttttggcccccgtccagcttcccgctatgtgacctttggcattttacttcaatgtgcctcagtttctacatctgtaaaatgggcacaatagtagtatacttcatagcattgttataatgattaaacaagttatatatgaaaagattaaaacagtgttgctccat

SEQ ID NO: 1209 - DNA, 2524 bp, Homo sapiens
ctcccgcggctgcgccggcccggccgcccaggagacaaagcgctgccgccgccgtcgccgccaccgggccagtcccgaaccatggccgggccaccccgcaacctcgcgcctcccgtcccgtcgccgccctaggcctgcgctgcgagatgcagaaacagaggcccagagagatgaatagcctgcctggggtcccccagccccagccccagtccctgcccttgcccccgtccctgccctctgccctggccccagtcccatccctgccttctgccccagccccggtcccagccctgcccctgccccgccggcccagtgccctcccgcccaaggagaatggctgcgctgtctggagcactgaggccaccttcaggcctggacccgagccccctccaccaccgcctcgccgccgggcctcggcaccccacgggcccctggacatggcccccttcgcccggctgcacgagtgctatggccaggagatccgggccctgcgtggccagtggctcagcagccgggtccagccctgaggccaccagggcgcctgttttagggggacacaagctctatgccctctgggacaggccgggtcctggagagactgggggagcagatcctgagggaaatcatgggcaaggctggcccccaggccctgagtggcctggttttgggggatgcaggctctgagaaggtgctggattctgagtgggcctttaggaccatgtgacccagaaggcctacccttgaggggaacgtcacgtgcaacactaaggagaatccagggcctgagggggaggtttcctgagaactccggccccaggctggcctgagctgccgggcagaggcctgtgctggcaacaggcattgccgggcctgcagctcagagggtcactgggactgagggcgatctgtggcctgaaaagcaaatgcacagttagtgcagctcctgaccaggccttcagggtggacagagggaggatcggtcatggcagccacacctgggcctggccttgctccgggacctgccagaggagctggcctggctctgtgcctgcctgcctccaggagcaggacggtggctgggagggtagtgactggggacacaggtgcaggtgttagtgcaggaccggaagggtgaggtggcctggtcctcggggctcctggcctgggctggctgaggcaggactctgccaaaagtcccctgccaggcctcatggtggtgctcctggtggcagtggctctctggccgcgggccctgtctgtgtctccgtggtggctctcacagggctctccagacactccttgactgcatccttcagtcttggcccctaggcctggggccccttgggagcttgcctgacctcccttcctgggctgggtagccatggcccgaggtgaccttctagcaggttcccccagggaggggaggccaccagctgactcaccgcctaggaaggcccaggtgctgacctagtggcggagaaaaagccgcacaccgagtgtggcttccagagcccctcttcagctccaggcagccccctctaacatgtcccctcctgagctcagcccccacccccatactcctggtggggaccaggtcttgcttggcttcggggctgaccgccggtcccctttcttctcaccacagtgcccatttttcatccagggagaacctcggggctgggacacctcctggccctcaccctgggtcatgtttacagtcctcagtgccccacaccggtggccccctgaggacacctccaccctgaccttgattttcccaaacgctgcctcttggtgacagactcagcccaaaaccccttccttctgtctctggagacccttgagcttggggaaatatggaggggtgtgtgtctgcaatcaaggcctctgcagctcacggctggcccggtgggctgggacttccgtctgaattttaaatacttagggttcatttttttttctctggcaacaaagcttgatgttttcactgctttagtttcctgtttgctggtgggaggggatacggtctgtgactctggacttgctctgggggaacagttgtcactgcccccggggagaggggcagcttgggctggagaagcacagccagagacagagcccctcgagagggatccttggctgcttcattgtcttccccccagcaagccctgctctccacaggcacctctggggtcttggtatggtccccgctcacctccttccagagtcctgagtggtgtgggtgtgggtggcacaggatctggggcatgggaggggttcagagcttcccagagccccgtgtcctggcagactcagctggtgggctggggtgttaaccccagtcctggcgtaggtttacagactctcaaggtacgttggccctggtctcctgggagagaggggtgagggatgtcccctaccaaagcacaaggtgggatcaggctgcctcctgggttgggtgtcgggggagctgtccggcagcctggcagggagatgcaagggctaaagtaaaattttgtcaagt

SEQ ID NO: 1210 - DNA, 2007 bp, Homo sapiens
aggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggttgagcacctttggaaacaacatttaagggaatgtgagcacaatgcataatgtctttaaaaagcatgttgtgatgtacacattttgtaattaccttctttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtgggaaacctcattgttctgtacaaagtactagctaaaccagaaaggtgattccaggaggagttagccaaacaacaacaaaaacaaaaaatgtgctgttcaagttttcagctttaagatatctttggataatgttatttctattttttatttttttcattagaagttaccaaattaagatggtaagacctctgagaccaaaattttgtcccatctctaccccctcacaactgcttacagaatggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctcc

SEQ ID NO: 1211 - DNA, 2480 bp, Homo sapiens
ctacccccagactccaacccggaactaacctcggctcccttgggaaggccgcgttgcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccgcggaacgtggtgaagattgccatcaagatgcgtgacgccatcccgcagctcatccagctggaccaggcgaagcccctggccgctgtgctgaaggaggtgtgcgacgcgtggagcctgacgcactctgagcgttacgccctgcagtttgcggatgggcaccggagatacatcaccgagaatgaccttgaggctgagcagctcttgggtgggctgcagagtaacagtcctgaagggcgccgggaagccctgaggcgccttgttccgctggcctcggacatgatctttgccagggaggtcatcagccgtaatgggctccagatactaggcaccatcattgaagatggggacgacctaggagaggtgctggccctcagcctgagggccttctcagagctcatggagcacggcgtggtgtcctgggagactctgagcatcccctttgtgaggaaggtggtgtgctacgtgaacatgaacctcatggatgcctccgtgcctcccctggcccttgggctgctggagagtgtgaccttgagcagcccagccctgggccagctggtcaagagcgaggtgcccctggataggctgctggtgcacctacaggtgatgaaccagcagctgcaaaccaaggccatggccctgctgacagccttgctgcagggggccagccctgtggaacgcaagcacatgcttgactatctttggcagaggaaccttcgccagttcatctataagaacatcatccacagtgcagcaccaatgggcgacgagatggctcatcacctgtacgtactgcaggctctcatgctggggctgctggagccgcgcatgcggacgcccctggacccctacagccaggagcagcgggagcagctgcaggtcctatgccaggctgccttcgaggtggagggggagtcctcgggtgccgggctaagtgctgaccgtcgccgttccctctgtgcccgagagttccgcaaactgggcttttctaacagcaacccagcacaggacctggagcgcgtgccccccggtctgctggccctggacaacatgttgtacttctccagaaacgcgcccagcgcgtacagccggtttgtgttggagaacagcagccgcgaggacaagcacgagtgcccctttgcccggggcagcatccagctgacggtgctgctgtgtgagctgctccgtgttggggagccctgctctgagacagcccaggacttctcacccatgttcttcggccaagaccagagcttccacgagctcttctgtgtgggcatccagctgttgaataagacctggaaggagatgcgggctacacaggaggacttcgacaaggtcatgcaggtggtgcgggagcagctggcccgcactctggccctgaagcccacttccctggagctcttccgaaccaaggtgaatgcgctcacttatggggaggtgctgcggctgcggcagactgaacggctgcaccaggagggcacactggctccccctatactggagctgcgggagaagctgaagccagagctcatgggcctgatccgccagcagcgcttgctccgcctctgtgaggggacgctcttccgcaagatcggcagccggcggcgccaggataagctgtggttctgctgcctgtcccccaaccacaagctgctgcagtacggagacatggaggagggcgccagcccgcctaccctggagagtctgcccgagcaactccctgtggccgacatgagggcactcctgacaggcaaggactgcccccatgtccgggagaagggctccgggaagcagaacaaggacctctatgagttggccttctcaatcagctatgaccgtggggaggaggaagcgtacctcaacttcattgccccctccaagcgggagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgtaccttg

SEQ ID NO: 1212 - DNA, 2907 bp, Homo sapiens
agctccgggcgttcgcttgcaagatggcggcggcggggcagtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctggctttcatccctccttttatccgaatgtccggccctgcggtcagcgcgtccctggtcggagacaccgagggtgtgaccgtgtccctggcagtgctgcaggacgaggcgggaatattgccaattccgacgtgtggagtgctgaacaatgagacggaagactggagcgtgactgtgatccccggtgcgaaggtgttggaagtgacagtgaggtggaagagaggtctggactggtgttcctccaatgagacagattccttctcagagtccccctgtatcctccagacccttctggtttcagcatctcataattcatcctgttcagcacatctactcattcaagtggaaatttatgccaactcttctctgacccataatgcctcagagaacgtgactgtcattcctaaccaggtgtatcagccccttggcccttgtccttgtaatttaacagctggagcctgtgatgttcgctgctgctgtgaccaggaatgctcatcaaatttaacaacgctgttcagacggtcctgcttcaccggcgtgtttggaggagacgtcaatcctccttttgatcagctctgctctgctgggacgacgacacgtggtgtccccgattggtttccctttctgtgtgtgcagtccccccttgccaacacacccttccttggttacttctatcatggtgctgtttcccccaaacaggactcttcctttgaagtatatgtggatactgacgcaaaagactttgcagactttggttacaaacaaggagatcccattatgactgtaaagaaggcatattttactattccgcaggtgtccctggctgggcagtgtatgcagaacgccccagtggcatttcttcacaattttgatgttaaatgcgttactaatttggaactataccaagaacgagatggtattatcaatgcgaagataaagaatgttgccttaggaggcatagttacaccaaaagtgatctatgaggaagcaactgacctagacaaattcatcaccaatacagaaactcctttaaataacggatcaacccccagaattgtgaatgtggaagaacattatattttcaaatggaataataataccatcagtgaaataaatgttaaaatttttagggcagagattaatgcccaccagaaagggataatgacacagagatttgtagtaaaatttttaagctataatagtggtaatgaagaagaattatctggaaatccaggttaccaacttggcaagcctgtccgagctctaaatatcaacaggatgaataatgtcacgactttacatctttggcaatcggctggaaggggtctgtgtacatcagcaactttcaaacccattttatttggagaaaatgtactctctggatgcctgttagaagtcgggattaatgaaaattgtactcagctcagggagaatgctgttgaaagacttgattcattaatacaagcgactcacgttgcaatgagaggcaactccgattacgctgatcttagtgatggctggctcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcagtgaactggcagtaccagtgtgggcttacctgtgagcacaaggccgaccttctccctatcagtgcatccgtccagtttattaaaattcctgcacagttaccccaccccctgacaagattccagatcaattatacagagtatgactgcaacagaaatgaggtgtgttggccgcagcttctatatccatggactcagtattatcaaggggagctgcattctcagtgtgttgctaagggcttactgttgctgttgttcctcacattggccttgttcctcagcaacccctggaccagaatatgcaaagcctatagttagacaaccacctggcttttatttttttgagatggagttttgctcttgttgcccaggctgaagtgatctcggctcaccacaacctcctcctcttgggttcaagcgattctcctgcctcagcctccggagaactgggattacaggcatgcaccaccacacccggctaattttgtatttttagtagagacagggttccaccgtattggccaggctgctctcgaactcctgacctcatgatccgcccatcttggcctcccaaagtgctgagattacaggcatgagccaccgcacccggccttttttttttttttttttttttttgaggcggggtctcactctgtcacccaggctggagtgcagtgcacaatctcggctcactgcaatctctgcctcccaagcaatcctcccacctcagcctctggtgtagctgggaccacagatgctccaccatgcctggctgtatttttggtaaagatggggtttcgccttgttgcccagggtggtctgtaactcctgagctcagatgatctgcccacctcggcctcccaaagtgctgggatcacagacgtgagccactgcgtccggtccatctgacttctcaaagactttagaccttgacttcagtgatttgttgtagtcttgtatgcttctctataaaattttaataaatgaaatgtcttatttttgtag

SEQ ID NO: 1213 - DNA, 2441 bp, Homo sapiens
gctttctcttagtggttacagttggcgctgtctccgctttcctgtttcgtggcgggcatcttggccaaaacactctccctgccaccttattcctctagggttgtgatttttttctttcaccaagaaatatcactcgctggtaatttgtcaaactgaagaaacccctgaagaagcagtggtgggcaggcgccaacgctgcggcttccagagcattttggcaaatcaaagccagggaccgttgctgggcctcatttccgcaacttttcggctccgaactgcttctttgacttagaaggatatcttatcctgccgttgtaatggcagctgaactgcgaatgatactttatgaagatgattcagtacaagtacaatatgttgatggttccacattgcaactttctccctgtggctctgaatttttatttgaaaagtcaccacctgtttcagcacatcctttagaacaaccagaaagaattcgtcaaaggacacattttgtcattagcacttacagagagcaactacagcgagccctagattttcgaaactcttcagctacttgcccttttttatctgaaaccatcataccttctgaaagaaaaaagcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagaggaatggaaatatcctttgtctttagcacttcattttcataacaaaatcagcaatatgtctaaaattgatgcacatataactcagagtagatttttaacttctgatatttcagaggaaagaggaaaagtggtttctgttcttcccagggccctgtcactcagctgtccagtcccacacctacacaggtggaatttttgtgattcacttttacagagacaatctgatgaatattcctatcctgaactagtgaaaatggtttggtacaaaggtgttacatatagacttacccatcaaaatatgaactcaatagagatttattctggggatggatctgttttcaaatcagaaggggcttattttgggaactattttacttattattctattcaagaaggatcaggaaagagagaagagaaaacttactcagtaaataaccttcctccagatagaccgggaagtccattcactgtcggttctctaattaaacaggcaacaagaattcttcaacattgtgtgaagatgagactttctttaagccataactatcgtatatgctgctggaaaatggtacctgggataaatgatagcaatatactgcctttggttttgaaagagtcactcatacccagtgtgggaagatttcttgcctactctgatgacaaagtacatgctatctttttagatggcattactctaaccctaaattggaatttcagctctcctattgagaagagacaggtaaatcaaggtcttaacttaggttggtgtaagttaacttttcctgatggacaagagcagttaattcagattgaacaccctgaaccatatgaaagatatgtgacaacagtaacatcatggtgcaggagactgacccagactagtcccagagagatgcccactcattcgtcatcttctgttctccaagaaaattggtctgttgcttctgaacttgaaaagatacagaagtttaacttgctactagaaaatagtggtatcctaaaccagatttctaacaagaaaaatgaacaacagtcttttgatcattataaaccaggatcttcagaaaccttgctaggagaagttaatgaaaatagagtatcaatagcattgaaaaaaacctctgaaatccttcacgatattgactgtcttctatcaaactctaaaaagtgaaaaatggaattattacaacatattattaaagtttaaggatgttgtttcaagtgactggtataaaattactagtaagccaagatattgtacgtattaccccggcacaatgattgtgaaagaactgacatttaactttgaaggtatttttaacttgtacatttttaaaatatgtatttatatcttaataataaatatttcgaagttttg

SEQ ID NO: 1214 - DNA, 4068 bp, Homo sapiens
cattttgtagagaaacaagcggagttaaccgaagagggggtcgaggagagccggagtcggggacccaggagtttcctgtgtccagcgctgccggagccgcctgaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatattgtgaatcggcacggtcctgaggcagacaggcatttattacgctgcctattttcgcatgtggatttcagtggcgatggtaaaagcagtggcaaagatttccatcagactcagtttctgattcaggagtgtgcgttgctgattacaaagccaaattgtctcgaatacttgatgtggcccaggacttgaaggccttgtcaatgctgctaaatggtactccatttgcctttgttattgaccttgctgcacttgcttcacgtcgtgaatacctcaaacttgataagtggctcacagataaaattcgagagcatggggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcttgtgcagggagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccagtaggtggtcttggcacaggcagcctgactggtataggaactggtgctcttggactccctgcagtgaataacgacccttttgtacagaggaaactgggcacctctggactgaatcagcctacattccagcagagtaagatgaaaccttcggacttgtctcaggtgtggccagaggcaaaccagcactttagtaaagagatagatgatgaagcaaacagctatttccagcgaatatataatcatccaccacatccaaccatgtctgttgatgaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacagattgaaggactatccccagtattgtcagcatttggcttctatcagtcactttatgcaatttccacatcatttacaggagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccaccttctattaatactacaaatatagatacgttgcttgtggccacagatcaaactgagagaattgtggagcccccagaaaatatccaggagaaaattgcttttattttcaataatctctcacagtcaaatatgacacaaaaggttgaagagctaaaggaaacggtgaaagaagaatttatgccttgggtttcacagtatctggttatgaagagagtcagtattgagccaaactttcatagcctgtactcaaacttccttgacacgctgaagaatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctgcaatacattccacatcttgaggcctaccaaagctcctggctttgtatatgcctggcttgaactgatttcccatcggatatttattgcaagaatgctggcacatacgccacagcagaaggggtggcctatgtatgcacagctactgattgatttattcaaatatttagcgcctttccttagaaatgtggaactcaccaaacctatgcaaatcctctacaagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtggacatgttgagtgaaattaacattgctccccggattctcaccaatttcactggagtaatgccacctcagttcaaaaaggatttggattcctatcttaaaactcgatcaccagtcactttcctgtctgatctgcgcagcaacctacaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccacactcactacttcagttgcaccatgctgtacctttttgcagaggccaatacggaagccatccaagaacagatcacaagagttctcttggaacggttgattgtaaataggccacatccttggggtcttcttattaccttcattgagctgattaaaaacccagcgtttaagttctggaaccatgaatttgtacactgtgccccagaaatcgaaaagttattccagtcggtcgctcagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctgg

SEQ ID NO: 1215 - DNA, 2317 bp, Homo sapiens
aaatctgtccgcccccttggccactgatcccccgaagagcttctgtcgccgctctaggaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtcaaaatcctttagcagttatgtatatattttctccattgtgtgtttaaattatgtcatgtccagttgccaagcacaatgaaaaagatgtattattttttaaattgaataaaaaattaggaaaaataaaatttctaattattatttttagtatgatatttttaacaagagtctataggcaaacaatatagggtgtgctgtgcattgtcagccctatactgtggtcttaataatgccagcttaaaaatcactgttgtgctctgcatttcgtgtgttagaagctgattctaggctgaggaaagcaagagttctctacttttgctcaatattgaggcttacccagtttgactctacagccagtgaagtggtttattgcttcaataaaaatatacttgaatgatgaatttatttatgttttgttttgtttttatttagagatggggttttgccatgttggccaggctggtcttgaactcctgacctcaggtgatccacctgcctcagcctcccaacttgctgggattacaggtgtgagccaccatgcccagcctgaatgatgaatttatgtgaacacaaagccctctgaaaaattaatgattttcaatttgttgtcttcttgaaaactgaatttaagtattatttaaacagaaaagtgtcagaaatcaaatgcagtatctccctctcccttttttaaatgttgaattagtagggtttttgtatagctttttgtattgtgtgtatttatgatatgtgaaatgtacataaaattaaacaatgtgaaaat

SEQ ID NO: 1216 - DNA, 1435 bp, Homo sapiens
ctgaacttccccgttcctcttctcggctgcctccttttccgttgtcccttcgcgccccaaaccacatcctggagcgcactctccagcgtggctggcagcggggacggtgcgccggggcgcaggcccaagagtcgcgtgcgcggccccttgcaccatccccccgggcccacccccgggccgcgctgattgggcaggtagggactctgcccagcggaaagttttgggtgccgggaggaagtctaacctttgggagactccaagacagcagctccgaggtcggcgggggtctgggtggccatggaggagccccctgtgcgagaagaggaagaggaggagggagaggaggacgaggagagggacgaggttgggcccgagggggcgctgggcaagagccccttccagctgaccgccgaggacgtgtatgacatctcctacctgttgggccgcgagcttatggccctgggcagcgacccccgggtgacgcagctgcagttcaaagtcgtccgcgtcctggagatgctggaggcgctggtgaatgagggcagcctggcgctggaggagctgaagatggagagggaccacctcaggaaggaggtggaggggctgcggagacagagccctccggccagcggggaggtgaacctgggcccaaacaaaatggtggttgacctgacagatcccaaccgaccccgcttcactctgcaggagctaagggatgtgctgcaggaacgcaacaaactcaagtcgcagctcctggtggtgcaggaagagctgcagtgctacaagagtggcctgattccaccaagagaaggcccaggaggaagaagagaaaaagatgctgtggttactagtgccaaaaatgctggcaggaacaaggaggagaagacaatcataaaaaagctgttcttttttcgatcggggaaacagacctagatccaaggccacaagtaaggctatggctctgattctagaagacaaccttccaagatgcctggcaaaaccacctccctgtgccacacagacacactaggcctgtgtatttatttccccttcaaagcagactgaggagggaggagacgaggttctcttggcatcactttctccctggctgcagaactagacacccttgaagatttggcctgggccagtgagactgaaatcaagaaaaacagaagggatgtgcagggtgggggggtccacttcctgctcccatgtcaacccccagggcctccagtgtgcagacgcgtgtcctactcatctgctcccacggatgaccctggtcttcaatggttagcagaagggagaaaagaaagcaggaaaatgtgctattgagattccagtggtgacttcactgatatttagtgaatatttgatttagccaacatgcctttctttatgtgattttgtattaaagtaaaatgatttttatactttc

SEQ ID NO: 1217 - DNA, 1454 bp, Homo sapiens
gcaagcggtgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggctacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacaggtgagtgggatgggagagatgggataatcaaccataaacctttggtgagctcttttacagtttcacttatggcttctactccatttactcattcacatatttaagcaaggggctgctgtgtgtcaaatattaggctgtgcttgatctgtgaaccagcagacaggttcctctcttcctgcagtttacattcttgggtggtgaaagtttgatgttaaagagtcaattatatagttaatgtcttaattactcttatgataatgacaaggtaagggaatttcaaaccactcttcctttctacctcaaagcaagcccttggggaactcatctgtcactgctctatttgtaaagtttttcctgggaatcccagtgggaaaggagatgagggccacagaaataatagaggagggaagtgacaagggcaccagaagctttatgaccaagttctagggttcttgggtcatacctattgttgacctaaaggaaaaaactgaggcaaacttaacattaagtaaagtatatttggtcaggttttgaggacagcctttaggagcaaagattcaagttgccgtgaaaatacactctgattagcagcagttataagtaggggtttttttgtttgttttgttttgtttttgaagacagtttcactatgttgcccaggctggtctcaaactgctgggcttcagcaatcttcctgccttgacctcgcaaagtgctgggattacaggtgcaagccaccacaaccagcccacaagtaggtttttaaaggaaaagaagattggatgacgtgaagatattgaaaaaaaacaggctgactctgggcacactgcgtaggagttagccctgctctggaaggagccgc

SEQ ID NO: 1218 - DNA, 1566 bp, Homo sapiens
ccttgtcctgcccagatcttgtcccttctagtactggccttccccattcctgggggcccccgcccctccgacccccgccgaccggcgctggactacaactcccggcgtgccgcgcgcgtccggccggctgcaccggggctttgcgcgtggcggccgccgagctccgcgcggggcaaacctcccggcgcggccatgcggggagttgctgaagtaaaggaaccctgcagccttcccatgctatctgttgacatggaaaacaaggaaaatggctctgtcggtgtaaaaaattccatggaaaatgggagaccacctgatcctgcagactgggccgtgatggatgtcgtcaattatttccgaaccgtgggatttgaggagcaagctagtgcttttcaggaacaggaaattgatggaaaatccctgctattgatgacaagaaatgatgtgttgacaggacttcagttaaaattggggcctgctctgaaaatctacgaatatcatgtaaaacctctgcagacaaagcatttaaagaacaactcttcatagtacagtcaaattggggtcttcgacctcaaaaaaatacataatgacataatttagtttcatgtaatgaaactttgtaaacagaatacatacatgtgtatatgtaaagaatttcaatcaaatgaaacgttatcctattggatagactaggcaattcatcagctcacctgaaatcagccaggaggagcaaggacaagatgcgcacagggtggttttcctcatggattttgtcaaatagatgatctttgacacgattagacactcctccccacaaaggctttgaaatcataaggattttcctcatctctttatagctttcccaaaatcttttaaaaaagaatttaattaaatgacagtcttttggttacagacttaggatgagtaaaaacaagaaaatttggggagggggagaaagaagaaagggattgctgtctcccttgaattcctctgttccttagagcttgtgttacttggacggaattgccaacacccttttttatagagggttctccacttgaccttattaaggttttattgggatatgctgcagtgtttgaaatgaacatgcatcatggccccttcaggagcagaatcatagctctgaaaagagaagctccgttgtgtactgaggatatccatccatattcagctagctttcaaatggggtaatgatattttctgcatagattttcttttaaattggttctttgtttctgaagaaagaattttttttaacttcatggttttatttataataatttgtttctgaagaaatttgccgagagttacaggtcaaaaagccttgttactagtacagaatatttttatatatattccttcatgatggtgtaattttttttaattgtcctatgctttgttcggttcctgggttaagtacttgtttttaagagcttggaaaaagtgggcttgctacatctctgttcaaagagacatttgttcaatctctgtgtgtcaacgccttgttgaattggtgctttgtggttgcaataaagcattgcttcagtt

SEQ ID NO: 1219 - DNA, 2060 bp, Homo sapiens
ctttcgaattccagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggaagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatgatgaagcctggaatggattcgtggctgctgctgaactgcccagggatgaggcagatgagctccgtaaagctctgaacaagcttgcaagtcacatggtcatgaaggacaaaaaccgccacgataaagaccagcagcacaggcagtggtttttgaaagagtttcctcggttgaaaagggagcttgaggatcacataaggaagctccgtgcccttgcagaggaggttgagcaggtccacagaggcaccaccattgccaatgtggtgtccaactctgttggcactacctctggcatcctgaccctcctcggcctgggtctggcacccttcacagaaggaatcagttttgtgctcttggacactggcatgggtctgggagcagcagctgctgtggctgggattacctgcagtgtggtagaactagtaaacaaattgcgggcacgagcccaagcccgcaacttggaccaaagcggcaccaatgtagcaaaggtgatgaaggagtttgtgggtgggaacacacccaatgttcttaccttagttgacaattggtaccaagtcacacaagggattgggaggaacatccgtgccatcagacgagccagagccaaccctcagttaggagcgtatgccccacccccgcatgtcattgggcgaatctcagctgaaggcggtgaacaggttgagagggttgttgaaggccccgcccaggcaatgagcagaggaaccatgatcgtgggtgcagccactggaggcatcttgcttctgctggatgtggtcagccttgcatatgagtcaaagcacttgcttgagggggcaaagtcagagtcagctgaggagctgaagaagcgggctcaggagctggaggggaagctcaactttctcaccaagatccatgagatgctgcagccaggccaagaccaatgaccccagagcagtgcagccaccagggcagaaatgccgggcacaggccaggacaaaatgcagactttttttttttttttttttttttgagatggagtctcgctctatcgcccaggatggagtgcagtggctcaatctcggctcactgcaaactccgcctcccgggttcacaccattctccggcctcagtctcccgagtagctgggactacaggcacctgccaccacgcccggctaatttttttgtattttcactggagacggggtttcactgtgttagccacgatggtctccatctcctgacctcgtgatctgcccacctcggcctcccaaagtgctgggattacaggcgtgagccaccgcgcctggccaaaatgcagacattttattagggggataaggagggcaaggtaaagcttatggaactgagtgttagtgactttggcatttgtgtagctgagcacagcaagggaggggttaatgcagatggcaagtgcaccaaggagaaggcaggaacactggagcctgcaataagggaggagagaggactggagagtgtggggaatgggaagaagtagtttactttggactaaagaatatattgggcgaagaatagagggggagcttgcaggaaccagcaatgagaaggccaggaaaagaaagagctgaaaatggagaaaaccagagttagaactgttggatacaggagaagaaacagcagctccactaccgaccccccccccaggtttgatgtccttccaagaataaagtctttccctggt

SEQ ID NO: 1220 - DNA, 1300 bp, Homo sapiens
agttccgtcgcagccgggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccc

SEQ ID NO: 1221 - DNA, 1837 bp, Homo sapiens
gtgcgctcccgggctgcgaggtctggctaggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaagacacatagtggatctgtatggcgtgtgacatgggcccatcctgaatttgggcaggttttggcttcctgtccttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaaatattccaagtcttcagaattcattaaatggatcttctgctggcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagc

SEQ ID NO: 1222 - DNA, 1764 bp, Homo sapiens
agaattcgggcaccaggagaaggaagccaacaggatccgacccggtgttttgtgacaaaggcaagacccccaggtctacttagagcaaagttagtagaggaggcagctaggcgtggctctcattccttcccacagaatggattataagtcgagcctgatccaggatgggaatcccatggagaacttggagaagcagctgatctgccctatctgcctggagatgtttaccaagccagtggtcatcttgccgtgccagcacaacctgtgccggaagtgtgccaatgacatcttccaggctgcaaatccctactggaccagccggggcagctcagtgtccatgtctggaggccgtttccgctgccccacctgccgccacgaggtgatcatggatcgtcacggagtttacggcctgcagaggaacctgctggtggagaacatcatcgacatctacaaacaggagtgctccagtcggccgctgcagaagggcagtcaccccatgtgcaaggagcacgaagatgagaaaatcaacatctactgtctcacgtgtgaggtgcccacctgctccatgtgcaaggtgtttgggatccacaaggcctgcgaggtggccccattgcagagtgtcttccagggacaaaagactgaactgaataactgtatctccatgctggtggcggggaatgaccgtgtgcagaccatcatcactcagctggaggattcccgtcgagtgaccaaggagaacagtcaccaggtaaaggaagagctgagccagaagtttgacacgttgtatgccatcctggatgagaagaaaagtgagttgctgcagcggatcacgcaggagcaggagaaaaagcttagcttcatcgaggccctcatccagcagtaccaggagcagctggacaagtccacaaagctggtggaaactgccatccagtccctggacgagcctgggggagccaccttcctcttgactgccaagcaactcatcaaaagcattgtggaagcttccaagggctgccagctggggaagacagagcagggctttgagaacatggacttctttactttggatttagagcacatagcagacgccctgagagccattgactttgggacagatgaggaagaggaagaattcattgaagaagaagatcaggaagaggaagagtccacagaagggaaggaagaaggacaccagtaaggagctggatgaatgagaggcccccagatgcagagagactggagagggtggggaggggcccagcggccttggtgacaggcccagggtgggaggggtcggggcccctggaggggcaatggggaggtgatgtcttctctctgctcagagagcagggactagggtaggaccctcaccgctgcgtccagcagacactgaaccagaattggaaacgtgcttgaaacaatcacacaggacacttttctacattggtgcaaaatggaatattttgtacatttttaaaatgtgatttttgtatatacttgtatatgtatgccaatttggtgctttttgtaaaggaacttttgtataataatgcctggtcattgggtgacctgcgattgtcagaaagaggggaaggaagccaggttgatacagctgcccacttcctttcctgagcaggaggatggggtagcactcacagggacgatgtgctgtatttcagtgtctatcccagacatacggggtggtaactgagtttgtgttatatgttgttttaataaatgcacaatgctctcttcctgttcttc

SEQ ID NO: 1223 - DNA, 1330 bp, Homo sapiens
ggtttttcgcaacccgggcggcgagatggcgctttggtgtaagcgaggaggacagtacaggacatgagtcctggtgagggacccgaggagcaggacagagaagacggcccctgaatcccatttggccccttgctggctggaggtgtgaaaaccagcggtggaggcagccttcggggcctgcatttgagaataagggtgtcactagttccaggcgtctgctgaaagatttggaacagaagatgatggccactccgaaccagaccgcctgtaatgcagagtcaccagtggccctggaggaggccaagacctctggtgccccggggagcccccaaacaccccctgagcgtcatgactctggtggttccctgcccctgacaccgcggatggagagccactcagaggatgaagatcttgctggggctgtcggtggcctgggctggaacagtaggagtccccggacccagagcccagggggctgctcagcggaggctgtgctggcccggaagaaacaccgtcggcggccatcgaagcgcaaaaggcactggcgaccctacctggagctgagctgggctgagaaacaacagcgggatgagaggcagagccagagggcctcccgggtccgcgaagagatgttcgccaaaggccagcccgtggccccctacaacaccacccagttcctgatgaatgacagggacccggaggagcccaacttggatgtgccccatgggatctcccacccaggttccagtggggagagtgaggccggggacagtgatgggcggggccgagcgcacggtgagttccagcggaaggacttctctgagacttacgaacgcttccacaccgagagcctgcagggccgcagcaagcaggagctggtgcgagactacctggagctggagaagcggctgtcgcaggcggaggaggagactaggaggctgcagcagctgcaggcgtgcaccggccagcagtcctgccgccaggtggaggagctggctgccgaggtccagaggctccggaccgaaaaccagcggcttcgtcaggagaaccagatgtggaaccgagagggctgccgctgtgatgaggagccgggtacctaggggtgcctcccagcctggtggacccaaggagaaggtcccatttcgtgcacactcaggccagctgggtctcaaggaggcaggtggcagatgaaaaccaccgtcaacaccctgtgcgccctgagaacagctaaatcggttcagactcccacctcaccgtttccatagttggctcttttgtgtcatcttaccctttacagagaaattaaatggccttggtgggaccaaatggg

SEQ ID NO: 1224 - DNA, 1266 bp, Homo sapiens
gagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagacatacaggtggtcttactctgcagcagctgaaactgaagcacaagaagcccttggaactatcatcaggacattgagtccattcttgcacaccgagaaaatatgcgacagatgataagaagtttttctgaaccctttggaagagacttgctcagtatctctgatggtagagggagagctcataatcgtagaggacataatgatggtgaagattctttgactgcaacgagttgttctcttgtgccttttggcgattttggtggtatgcatacagatgtcagctctttccagacaatggaccaaatggtgtcaaatatgagaaactatatgcagaaattagaaagaaacttcggtcaactttcagtggatccaaatggacattcattttgttcttcctcagttatgacttattccaaaataggagatgaaccgccaaaggtttttcaggcctcaactcaaactcgtcgagctccaggaggaataaaggaaaccaggaaagcaatgagagattctgacagtggactagaaaaaatggctattggtcatcatatccatgaccgagctcatgtcattaaaaagtcaaagaacaagaagactggagatgaagaggtcaaccaggagttcatcaatatgaatgaaagtgatgctcatgcttttgatgaggagtggcaaagtgaggttttgaagtacaaaccaggacgacacaatctaggaaacactagaatgagaagtgttggccatgagaatcctggctcccgagaacttaaaagaagggagaaacctcaacaaagtccagccattgaacatggaaggagatcaaatgttttgggggacaaactccacatcaaaggctcatctgtgaaaagcaacaaaaaataaatagccatgcatttgatttgtttagttttgattgttttaacagttagtaatggtgctgggtaataagcataagaccaatctcttgctgttaaatcagttctgtccttggcaactttcttctgatatctgaatgttcatgaaggtcctagctttatattgtccctcttttaggaataaaattttgattttc

SEQ ID NO: 1225 - DNA, 1069 bp, Homo sapiens
acccactaacacacggggcacacgtgtgaagtgcatggccaacgaggtcatggaggaccctgggcaggggtcgagcatggccaggatggaggcctctcagccagccccaaaggggaatttcccatctatgcctctggtgggagagggggaccgggtgaaggcaccaccagatgctgcacctggcctcgtggcaagcaattgcaagagcggttctgcagactcagggaagctggcagccccatggcacatccccaccattgctttacccgagggtgacatagaagaccagccacccccatggcagcccgaaaactgttgggaagagcaaacaccaggtttcaagagtcactttttgtccacacccagagcagggccccctggcagaagactggtccccagtgagagggcgaattcccccaaccccggctcccccggggagagcagtgcctgctcccctgctgccagcaacatttgggaggagtcttcccaggcccctggaggaccggagctgcttcccgaggagcctaatcaagccagcccctgggccagctccagtcctgccagggtcacccggagggaggacctgacccacgccctcgtgtgggagggcggctctgaccccctacttgagctgtcggcagaagacctccggaccctctctccaagaggttcattgctggatgtggccaccagcccagcaggcacctctgggagacttgagcttcctgcacagctagagaggacagcaagcaagccacctgcagtcccacccaaaacagagaaagccctgcggcgggcaaagaagctggcaagtaagaggaggaagacggatcaggctcaggagaagcatggcgagtcacaggagggaaagccctgcccggaggacttggagcagacacagcaaaggccgctgtgccccagagagaggccccgacacaatttccccgtggtccgttccctgccccctcccgtgcaccgccactccgtgtccggcttctcggagcctgtcgggaggcggcccgggggcccccagtccctcacacccctgcccacgtacacctccaccctc

SEQ ID NO: 1226 - DNA, 1359 bp, Homo sapiens
gagttccacatctgatacccaggagtctccagcttccaagagaggtcgggtcacagccagcagctatgtctgacataaatcttgactgggttgacaggcgtcagttgcagcgcttggaggaaatgctgattgttgtggatgagaatgataaggttattggtgccgacaccaagaggaattgccatctgaacgaaaacattgagaaagggctgctgcaccgagccttcagcgttgtcttgtttaacaccaagaatcgaatcctgatacagcagaggtcggacacgaaagtcacgtttcctgggtattttaccgactcctgtagtagccacccattatacaacccagcagaactggaagaaaaggatgccatcggagtgaggagggcagcccagaggcgtctgcaagcagagctgggaattcctggggagcagatttctccagaggacattgtgttcatgacaatctatcaccacaaggcaaaatcagacagaatttggggagagcatgaaatttgttaccttctgcttgtgaggaaaaacgtcactctgaacccggatcccagtgaaacgaaaagcatcctctacctgtcccaggaggagctgtgggagctgctggagagggaggcgaggggtgaagtcaaagtcaccccctggctaagaaccattgccgagaggtttctgtaccggtggtggcctcacctggatgacgtgaccccgtttgtggagcttcacaaaatacacagagtgtgagaggcagggaggtcgagtcagccatgtgtaatgccctcagtgcaggcagacgcaccattgaggcaatgatacaccctctccaaaaaacagggcaaaaggggcacttgattgcccatcatgtataaatcactatttcaaccttttcatcaactttgtcatatcttcattttcccttttccttatttccatatttctcatctgcctggttgcagggaggaaatttaacatttcctttgtcccaatttccattttataagcacttgtttgattaacagcagctgatcctgaaagtcttggggagatcttgagagtcctgaagcaggcagactagcctggctggaccatgaggctgtctccccacagctttatccaagcctccaaggtcaggatgggatctctgtatcatgtttttctttttaaatcacttatttcagagtgcaacacaaggctgcatttttaaaaaaaagacacattcaatcttgcatcctaatacaagcagtacggaagatgcgtatggtctcagccaagtgactcgacgtttatccacttctgttcatttgatcgtttcagtaatatgcttacaaataaagacatacttgctttaaaacat

SEQ ID NO: 1227 - DNA, 1287 bp, Homo sapiens
actcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtacagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggatatcaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagaccgag

SEQ ID NO: 1228 - DNA, 1336 bp, Homo sapiens
aaaagaggtgggatcgtttgtcgcgatgtggagtggccgtaagctgggctcctccgggggttggtttttaagagtgctggggcctggaggctgtaatacaaaagctgcgcgtcccttaatttcctcggcggtttatgtgaagaaccagctcagtgggactctacagattaaaccaggggttttcaatgaatacagaaccatatggttcaaatcctacaggacgatcttttcctgtttgaacagaataaagagtttcaggtacccttgggcgagactgtacagtacttcccaaaccactgtcgacagcggtgaggtaaaaaccttcttggccctggctcacaaatggtgggatgaacaaggagtatatgcacctcttcattccatgaatgacctgagggtgccatttattagggacaatcttctgaaaacaattcctaatcaccagccaggaaaacctttgttggggatgaagattcttgacgttggctgtggtggtgggctgttaactgaacctctagggcggcttggggcttcagttattggaatcgaccctgtggatgagaacattaaaacagcacaatgccataaatcatttgatccagtcctggataagagaatagagtacagagtgtgttccctggaagagattgtggaagagactgcagaaacatttgatgctgttgtagcttctgaagttgtagaacatgtgattgatctagaaacatttttacagtgctgctgtcaagtgttaaaacccggtggttctttattcattactacaatcaacaaaacacaactttcctatgccttgggaattgttttttcagagcaaattgcaggtattgtaccaaaaggtactcatacatgggagaagtttgtttcacctgaaacactagagagcattctggaatcaaatggtctgtcagttcaaacagtggtaggaatgctctataaccccttctcaggttactggcattggagtgaaaataccagccttaactatgcagctcatgctgtgaaatccagggtccaggaacacccagcctctgctgagtttgttttaaagggagagacagaagagctccaagctaatgcctgcaccaatccagctgtgcatgaaaagctgaagaaatgaattgtttctgagaactatagtaatatggcttggatatctgatgttttcaaatacaagaaatgtacaatttatcctttgagagagaatcatgaagaaaagaaggtcaataaaaagggctaaaaccttggacaaaagtttttgttatttcgtctaatagctactttcaagggattctgtgaataaaaagttttgtcaagatat

SEQ ID NO: 1229 - DNA, 1425 bp, Homo sapiens
actgcgcgcgcctccaggcaccggcgttagcgggtcgccgacccgcaatccccgccgcggctgcttgcctaccggagtgtgcgccggcacctgccgccggagacatgttgcaaaaaccgaggaaccggggccgctctggcggccaggccgagagggacagagactggagccatagcggaaaccccggggcttcgcgggccggggaagacgcccgggttctcagagacggctttgccgaggaggccccgagcacgtcccgcgggccgggcggctcgcaggggtcgcagggcccctcgcctcagggcgcccgccgggcccaggccgcccccgccgtggggcccaggagccagaagcagctggagctgaaagtgtccgagctggtgcagttcttgctgattaaagaccagaagaagattccgatcaagcgggccgacatactgaagcacgtcatcggggactacaaggacatcttccccgacctcttcaaacgggccgccgagcgcctccagtacgtcttcgggtataagctggtggaacttgaacccaagagcaacacttacatcctcatcaacaccctggagcctgtggaggaggatgccgagatgaggggtgaccaaggcacgcccactacgggcctcctgatgatcgtcttagggctcatctttatgaagggcaacaccatcaaggaaactgaagcctgggactttctgcggcgcttaggggtctaccccaccaagaagcatttaattttcggagatccaaagaaactcattactgaggactttgtgcgacagcgttacctggaataccggcggataccccacaccgaccccgtcgactacgaattccagtggggcccgcgaaccaacctggaaaccagcaagatgaaagttcttaagtttgtggccaaggtccataatcaagaccccaaggactggccagcgcagtactgtgaggctttggcagatgaggagaacagggccagacctcagcctagtggcccagctccatcctcttgaaaggtggattcagagggacccccgggacaagggtctgagacccaaaggcacagtttagaggattgggggaagggagaacgaacccagggagcatattgctgtaaacgcttcaatgtgtgtagctttaggatgtgtttgcaaagttttgtttttttaatgttgtgttattttgctccagattttcatctataaacaaaggagcatttgttttgattttactctttttggtataaaaaattttgctagcttagtaaaacgaattggaaaacttgactatgatctggaacagataatgcaagaaggaacacataagtaagttgctttggtgccaagaaaataaaaaagctattatcaggtctcctaactaccccagtttgtaaggaaaaataaaagtttttataaaatt

SEQ ID NO: 1230 - DNA, 1310 bp, Homo sapiens
ccctgcttctggacctatggattctccatctagcgtttcttcctattcctcctactctctctcttcgtcttttcccacctccccagtgaacagtgactttggcttcccctctgatagtgagagggaggacaagggggcccatgggcccaggccagacactgttgggcagaggggaggttcacggcccagcccgggtcctatccgctgcaggcatcgatcgaaggtttccggtaaccagcatacaccatctcatccgaaacagcggggttcggcttctcctatggcaggatctggggcgaaaagatcaagagatggtgaactggagaccagtctaaacacccaaggttgtaccacagagggagacctgctgtttgcccagaagtgtaaagaactccaaggatttatacctcctctcacagacctactcaatgggctgaagatgggtcgttttgagagaggattaagcagttttcagcagagtgtggcaatggacaggatccagcgtattgtaggtgttttgcagaagccacagatgggggaacgttacctaggaaccttgctacaggtagaagggttgttaaagacttggtttccacaaatagctgcccagaagtcatcattgggtggtggcaagcatcagctgaccaagcattttccaagccaccacagtgattcagctgcttcctctcctgcatctcctatggaaaagatggaccagacacagctaggacatctagctttaaaaccaaagcagccttggcacctcacacaatggccagctatgaacctcacctggatccacaccactccaatttgcaacccccctctcagctccccaggtactatctcctttagccatggtcctttaggcactggaaccggcattggcgtcattcttttcctccagcatggagtgcaacccttcacccactctgccccaaccaccccagtcccacctactacagcatctcctgtcatccctggtgagcctatgaaactatctggagagggtcctcgttgctacagtttgccagtaactctgccatcagactggagctataccctatcccctcccagtctacccaccttggccagaaagatgaccataggacaccgggagcagcagagaagccatcctccagttgctgctgatgctcatcttctcaacctctagcccagggcatacagctgtccactgtgacttctactttgtgtaaatatttatgtatatatgtatttttactattaatgtgtgcatttgtgttgagggaagataaatcctttctgattaaagaaatttttttatacct

SEQ ID NO: 1231 - DNA, 1692 bp, Homo sapiens
agtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggagcctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctgatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttattttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttcc

SEQ ID NO: 1232 - DNA, 1432 bp, Homo sapiens
aaaaaaatgccaccctggagcgggagccgcaatggcacgctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatgatgattctgacagtgctgatgatgcaacaagtaattaactttctgtgacgcaaagctgggaaggcagctgtggctactttccagttgttctagaaagctagcgcctaggcctttgtcagcgctttggctgtgcaccaagttcttctgagatctctgaactttcctagaagctctttattaagggtcgtccttcaagcttgtcttcctcctaggcacttgactatggctccacatcagatgcagggtcggggaggggtagactggtagggcttctgatttcttactgattggtttctaatctctgtgtttaggccacttgattatttgagtatgtgtgtgtatgtggcaaaacaaaagccaaagaagaatgcagattatagaaatctctactatgtgtgcatatggggcaaagcaaaaagccaaagaagaaacagattataataaatctctaggaactgttctctgtctgtttccttcttgtacttattcctcctggtggcaagcctcttctccctctagtaaccaagctggggtgcttcctcttgcccagatttgtgctctgatttcttacagctaattctgtcatctctagaaccagccacttcagcttcctgcacactctagaaatctctttatactttttttttttttttccgagatggagtcttgctctgtcgcccaggctggagtgcagtggtgcagtctctgttcactgcaacctccaccttctgggttcaagcaattctcctgcctcagcctcccaagtagatgggactacagatgtgcaccaccaggcccagctaatttttgtatttttagcagagatggggtttcaccatgttggccaggctggtctcgaactcctgacctcaagtaatccacccacctcagcctcccaaagtgctaggattacatgtatgagccaccacacccggccctctttatacttttaaaactgattgttactctagttaatgtctatgtttatttgtccaacagctattctatttgtccataaacttttttgagtgcctaatatgtacagttgactgtaacttaaacaaaataaatgcattgcctat

SEQ ID NO: 1233 - DNA, 1263 bp, Homo sapiens
ctaggtgtcatggctgccccaagagtctagagacgacaacttctccgcttcctcggcgatggcggcgtccgggagcggtatggcccagaaaacctgggaacttgccaacaacatgcaggaagctcagagtatcgatgaaatctacaaatacgacaagaaacagcagcaagaaatcctggcggcgaagccctggactaaggataaagggagaagccaagatttcgattcatgtcttgacttccgacatgagtcaccattactttaagtactgcaaaatctcagcattggctctgctgaagatggtgatgcatgccagatcgggaggcaacttggaagtgatgggtctgatgctaggaaaggtggatggtgaaaccatgatcattatggacagttttgctttgcctgtggagggcactgaaacccgagtaaatgctcaggctgctgcatatgaatacatggctgcatacatagaaaatgcaaaacaggttggccgccttgaaaatgcaatcgggtggtatcatagccaccctggctatggctgctggctttctgggattgatgttagtactcagatgctcaatcagcagttccaggaaccatttgtagcagtggtgattgatccaacaagaacaatatccgcagggaaagtgaatcttggcgcctttaggacatacccaaagggctacaaacctcctgatgaaggaccttctgagtaccagactattccacttaataaaatagaagattttggtgtacactgcaaacaatattatgccttagaagtctcatatttcaaatcctctttggatcgcaaattgcttgagctgttgtggaatgaatactgggtgaatacgttgagttcttctagcttgcttactaatgcagactataccactggtcaggtctttgatttgtctgaaaagttagagcagtcagaagcccagctgggacgagggagtttcatgttgggtttagaaacgcatgaccgaaaatcagaagacaaacttgccaaagctacaagagacagctgtaaaactaccatagaagctatccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatg

SEQ ID NO: 1234 - DNA, 1905 bp, Homo sapiens
aaaactagaaggtcagcaaaggaaagtggaagttggattctgaaagatcgaggtgcccacaggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcacactccattaaatctaaatgtgaggacatttccagaggccatcagtgggatccatgaccaagaagatggtgaacagtgtaaatcagtttttcattgggacatgaaatccaaggataaggaaggtgcacctaacaggcagccactggcaaatgagagagcctattggactggatatggggaagggaatgcttggtgcccaggagctctgccagaccccgaaattgtaaggatggttgaggctcgaaagtctcttggtgaggaatatacagaagactatgagcaacccaggggcaaggggagctttccagccatgatcacacctgcttatcaaagggccaagaaagccaaccagctggccagccaagtggagtataagagagggcatgatgaacgcatctccaggttctccacggtggcggatactcctgagctgctacggagcaaggctggggcacagcttcaaagtgatgtgagatacacagaggactatgaacaacaaagagggaaaggcagtttccctgcgatgatcacacccgcctatcagatagccaaaagagccaatgagctggcaagtgatgtgaggtaccatcaacaatatcaaaaagaaatgaggggaatggctggtccagccattggagctgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcactgcacattatcactcgcttccagctcaagacaacttggttctcaaacgggctcagagcgtaaacaaactcgtgagtgaggtggagtataagaaggatctggaaagtagtagaggtcacagtatcaactactgtgaaacacctcaattcaggaacgtgagcaagatctcaaaatttaccagtgataataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagcttggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggctaagtataaagaaggctgggagaagacaaaggggaaaggatttgagatgaagctggatgccatgtctctgctggccgccaaagcctctggggagcttgctagcaat

SEQ ID NO: 1235 - DNA, 1155 bp, Homo sapiens
cttacttgcacttgagactatggttgactaatgctctataaatccgaagagagttcggactataagtatttaggctatcattatgttgggcaaaaataagtaacccaatggtagataaatgaattcaaccagttgatcaaatggcagaaaagcagttagactacaatctgtgcagacagcatggacacaaagatgaccacaaggggcccaaaacagaaaagagaaacacaagctcacctcttggagctgcttctcctacacttctcagcccattgctttgccaccccctcatgtgccagggcatcccattccaggcttcctgcaaggaaacggttggaagtgggaaaggggagctagggattgaggggttaagggacctcacactaagaaggggctgtgctttgatcccctgcctcttgcactaccaatgtctcaagacataatattcatctcttgctgtcagacccattctatattctaaaagcttctgctccttccttcccaatttctcctttgtagcaggaaattacacccagccctcatctcaattaatgctaaataaagctattgtttttccaaaacacaaatctacactgggtctcaatatcagtgatgaggcttacaaaccaacacgttttctgccatgaggatttctctttaggccagaagtacaaaacaaaaaaaccaatggattttaaccaaaatgatttgaaatataggtgaggattcaggagaaggcaaaagctagaaacacttggggttgtcaacatgagtattacattaacattgcttgatgagaacctctaatgatactgacaacataaattacctagggtaaaggatagctgcaacaatgaaacaggaaagaagagagggagagagaggaaagggaaggaagaaaggaaggagggagaagggaagaaagaagcaatgtctaacccaaccctatcttgaaagttgaactcaagtagaaaaatggatagaaacaaaattctctagtactcatccaggaaaccattcttcaatgttgcatgtggctgtttgccaaggcacacaaagtgcttgtaggcagcaaccatatgctacaagaattgtaaactgcatacagtttgtttgaagtagacagtgaggataataacaaagttgctaggcagg

SEQ ID NO: 1236 - DNA, 1070 bp, Homo sapiens
acaatggctcattcacaccacaggcagtggaagctaactgtcagcgggagcccagctggggctgtcaaccacccctccccttgcgaacatttggcttctccagacttcttacatatggctggcttcctccagagcaagcatcctgagagagccaggcagaagcttcccagcctcacaagtcccagagcatccctttggccacggtctactggtcaaagcagtcacaacccacccagcttcaggaagagaggacggagcgcccaaggcttgaagagaggagtggcaaagtcacatcaaagagtagcctgcggggtggaaagtagtgtggcagccatctttggaaaacactgccacagccatctccctaagactgctggacttggggcacctgatggtagagaccttcaatttggaaaacccctctttggggtcaacagcatcctcattcactgaatgtcagaaaataggtgggttttaccgagaaaactgaataggcaggttcatttttaagcttgttttatttgaaagttatcttactggtgtgggacctaggattgtgtgttttcagaaacccctaaggggtcaatgaataatgttatagccacatagaaccaaatgagtatcatcagatagtcctgcaaataatgtcattaaggggaactataaagatatccaaatgaagtaatgcttatgagtattgtaaaaaattttgatctaagctatagtcacttagcattggtagtttaaagagtcttgggaagatgactgtcccagtgaagcttaggtcacacaaggcatgactccaactgtacctggctttgcgaacgtgcagctgaggatagtggctgtgcctgtgacatatatgcactgcaaagtcttcctcatacgtcagacacgggatgttccccacttggtcaaaaacagttatgagagttgagcctaaatcacagagataaagaaacatgtccttatttatcaagaaataaatttgggatgtcagaacaaaatgtagtttccattctaaattgtgcttaattgttctaataaaatatgcacatggtacattgagg

SEQ ID NO: 1237 - DNA, 1269 bp, Homo sapiens
agaggtgcagtaccagaggtggcgtgctgccgacttcgcgtttgccttgctggatgattccgcttgtttgccggctgcgtgagtgcttagagcttttcggtggaagatgccggacagtaacttcgcagagcgcagcgaggagcaggtgtctggtgctaaagtcatcgctcaggccctgaaaacgcaagatgtggagtacatatttggcatcgtaggcatcccagtgaccgaaatcgccattgctgcccagcagctaggcatcaagtacatcgggatgaggaatgagcaagcggttgatatctgtgcagaagaattggggaataatgtaaagcccgctgttactttgctaggaaacatacatgctgtcactaagcagcttttagaggaacttgataaaacaccatggcagtatcctccagagagcaagtggtggaaaactctgagagaaaaaatgaagagcaatgaagctgcatccaaggaactagcttctaaaaaatccctacctatgaattattacacagtattctaccatgttcaagaacaactacctagagactgtttcgtggtaagtgaaggagcaaatactatggacattggacggactgtgcttcagaactaccttcctcgtcacaggcttgatgctggtactttcggaacaatgggagttggtttgggatttgctattgcagctgccgtggtggctaaagatagaagccctgggcaatggatcatctgtgtggaaggagacagtgcatttgggttttctggcatggaggtagaaaccatctgcaggtacaacttgccaatcatactgttggtagtgaataacaatggaatttaccaaggttttgatacagatacttggaaagaaatgttaaaatttcaagatgctactgcagtggtccctccaatgtgtttgctgccaaattcacattatgagcaagtcatgactgcatttggaggcaaagggtattttgtacaaacaccagaagaactccaaaaatccctgaggcagagcctagcagacacaactaaaccttctcttatcaacatcatgattgagccacaagccacacggaaggcccaggattttcattggctgacccgctctaatatgtaaataaagacgccagttggtggtcttgagttttctctttcttgcaagatgaaattttattttccacagcaaaattactctactgttaaaattgtgcaaaataaaataaacatttaaaatgacattttacagtaaaggaattgattaaaaac

SEQ ID NO: 1238 - DNA, 1137 bp, Homo sapiens
gtcctgtccacaaggctcagcaaagcggctggcggcctggcccgggacctgctgctgctccagccatgtccatgacaaccagagcctgggaggagctggatggcggcctgggcagctgccaggccctggaggaccactctgcgctggccgagacccaggaggacagggcttcagcgacacccaggctggccgactccggcagcgtgccccacgactctcaggtggctgaaggccccagtgtggacaccaggcccaagaagatggaaaaagagcctgccgccagggggaccccaggaacggggaaggagaggctgaaagccggagcgagccctcggagcgtccccgcgcgcaagaaggcgcagaccgcgccgcccctgcagccgccgccgccgcccccggccctgagcgaggagctgccctggggagacctgtcgctcaacaagtgcctggtgctcgcctcgctggtggcgctgctgggctcggctttccagctgtgccgcgacgccgtccctggggaggcagcactccaagcacgtgtgcccgagccctgggtcccgccaagctcagccccgagggagccatcgtcgcccctgcctaagttcgaggcccaggcgcctccatcagcgccgcctgcgccccgggccgaggcagaggtcagacccaagattcccgggagtcgggaggctgcagagaacgacgaagaggagcccggcgaggccaccggagaggccgtccgggaggaccgtgtgaccctcgcagaccggggacccaaggagaggcctcggagagaggggaagccgcggaaggagaagccgcggaaggaggagagacctaagaaagagaggccgcggaaagaggagaggccacgggccgccagggagccccgggaagccctaccccagcgctgggagtcacgcgaagggggccaccggccgtgggcacgggactccagggacgccgagcccaggaagaagcaggcctgggtgtccccgaggcgtcccgacgaggagcagcggcctgggagtcgccagaagctccgcgcaggcaaggggcgggactgagccggccccgcgccggagtccaggggccccttctggacgccccgcgactctggcgaaataaagcgagtgctgcggc

SEQ ID NO: 1239 - DNA, 1424 bp, Homo sapiens
gatgcttgcccttttttagccagcggggccactgacggcttctgttgcacgtccggacccggacccagacccgagcgtcgcaagaaggcccgttggagtctcgcgcaactgggcaggacgcgacttctgacgaagtgacaatggtctatgcatatattaagtgaatatttgagaatttaaatatgcaaagcgtgagtacagtgttacccttaaattcacatatgcgcactgaaccagtcacctcatttttcggtaaacgaaaccacctaaagattaggtggtttcttggtgcaacatcgggtttgagactgcagaaaactaagtctggaaattgggccatttgttccccggggaggcagtgctttccttccagtaccccgtcggttgttatttggaacacctggcatttcacatggtctttggccatatgcccctggcttgagaaactccgtcatgaaaatcgacaagtgtgggtcagaaataagggaggacgacagtttcgttccttccatttcatgttttaaaatttttgtttcaacttgatcaggattcttttttagaaaagtattttccctcacagtgcagtcttaattgctgtggatttgtacagagctagagaactcaggttaacatttatgctcctagcaggagggggggcaagagatttgagtatttcatttttgtacttatagaattataactattcatttttgatgagctgtcttttcaattttggtatctcaagcttgttttccagagttcatggatggaaagcaccagacgagcagatggcatggtggaaagagcctccgagagggaattaggataactgagttccagtcctgaatcacttatagactactatatgtcttcctgaattgcagtcttcttatctgcaaagtgagaacaatagaatttactgtccctagcacatggggggttgctgagaggccaaaatgagagattgtacatgcagaacttgatgcgtggcattagagctgtatgaggccgggtgcagtggctcacgcctgtaatcccagcaattgggaaggccgaggcaggcggattgtctgaggtcaggagtttgagactatcctggtcaacatgatgaaaccctgtctactaaaaatacaaaaactaggtcgggcgcggtggctcatgcttgtaatcccagcactttgggaggccgaggcgggcggatcacgaggtcaggagatcaagaccatcctggctaacatggtgaaaccccgtctctactaaaaatacaaaaaaaaattagccgggcgtggtggcgggcgcctgtagtcccagctactcgggaggctgaggcaggagaatggcgtgaacccgggaggtggagcttgtagtgaggcgagatggcgccactgcactccagcctgggcgacagagctagactccgtctc

SEQ ID NO: 1240 - DNA, 2206 bp, Homo sapiens
acaattgtcgcgggtagtggggcgccccagctgccaactgcacgtggtttctttctggcgtttgcctagtgtcctgtccattccgccccgttgggaagtgggaagcggagaggttctgtggggacagagctgggagtcctgaaggagaaagcgcgcagccgaggggctctggagtgccttagagcagagctgcggccgcggaaggggagcagctgagaaaggagggccgctgcaggcggggttcgaaccgtggggtctgggctgctcccgcggggggcctgggcggacgcgggatgctgggggtccgctgcctgctgcggtccgtgcgcttctgttcctccgcccccttccccaagcacaaaccttcagccaaactgagcgtgcgggacgctctcggggctcagaacgcgagtggggagcgcattaagatccagggatggattcgttctgtccgatcccagaaggaagtcttgtccctgcatgtaaatgatgggtcatctttggaaagccttcaggttgttgcagattcaggccttgacagtagagaattaacttttgggagctctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtacctgcgacaatatcctcactttaggtgtaggactaacgttctgggttctatattgaggattcgcagtgaagcgacagctgccattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcaggagcttttactcaagtgtttacctttggtccgaccttccgagctgaaaattctcagaaccggaggcacctggcagagttttatatgatagaagcagagatttcttttgttgacagccttcaagatcttatgcaggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaat

SEQ ID NO: 1241 - DNA, 1682 bp, Homo sapiens
actgcgccgagggccgccatcgctattgcggcattctccctcggctccggaggtaggggcaactcttctcttcctgtctgggaaaaagaccatagctcaaaaggaaggccgagggagaagttagaaagggatgatgaacgaagcgttttgaggggactgcaacgccgcggcaatacccgcccctgagctgcgcgcactaccgcctcggtagctgtcatggccgccgggtcacgtgactccggcttggcgccgtcctggttttccgtcaccctggttctgtagtctcggttctccgactccctctttttctcgcttgtggactccgatatattgcccttcttcccttagaagaactgctgaaccgactctgagaaatttgaaaacatctggagaaaatgacccattggtttcataggaacccattaaaagccacagctcctgtgtcttttaattactatggtgtagtcactggcccttctgcttcaaaaatatgcaatgacttgaggtcatccagggcacgactccttgaactgttcactgatttgagctgtaatccagaaatgatgaagaatgcagcagattcatatttctcacttttacaaggtttcataaattctttggatgaatctacccaagaaagcaagttacgatatattcaaaatttcaagtggactgatacattgcaaggacaggttccaagtgcccagcaggatgctgtttttgaattaatttccatgggatttaatgtagctttatggtataccaaatatgcttcaagactggctggaaaagaaaatataacagaagatgaagcaaaagaagttcatcgaagcctaaagattgcagctgggatttttaaacatttaaaggaaagtcatctcccaaaactcattacacctgcggaaaaaggaagagatttagagtcacgactcatagaagcatacgttattcaatgtcaggctgaagctcaagaagtaacaattgctcgagcaattgaactaaaacatgctcctggactaattgctgcactggcgtatgaaacagccaatttctatcaaaaagctgatcatactttatccagtttggagcctgcatattctgccaaatggagaaaatatcttcacttgaagatgtgtttctacacagcttatgcttactgttaccatggtgagactttattggctagtgataaatgcggtgaagcaatcaggtctctccaagaagcagaaaaattgtatgcaaaggcagaagcactgtgtaaagaatatggagaaaccaaaggacctggaccaacagtcaaaccttcaggacatctgttctttaggaaacttggaaaccttgtgaagaacaccctagaaaaatgtcagagagaaaatggatttatttactttcaaaaaactccaacagaagccccacagctggaactcaaagcaaattatggtctcgtagagcctatacctttcgaatttcctcctacaagtgttcagtggacaccagaaacattggctgcatttgatctcaccaaaagacccaaggatgacagtactaaacccaaaccagaagaagaagtgaaacctgtgaaagaaccagacatcaaacctcaaaaggacactgggtgctacatctcctaaaatacaacttgcacttagaatttctctagcagtaaataagataaaccacag

SEQ ID NO: 1242 - DNA, 1153 bp, Homo sapiens
cagtacatttcaagttggtcgcggcttgggctccgctttggggaggggcagcaggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctcccttggagttccgcccagtacctttgccctcaggcgaggaaggggaatatgtcctggcactgaagcaagagctacgaggagccatgaggcagctcccctacttcatccggccagctgtccccaagagagatgtggagcgttattcagacaaatatcagatgtcaggtccgattgacaatgccatcgattggaaccctgattggcggcgtctaccccgggagctaaagatccgagtgcggaagctacagaaggaacggattacaattctgctccccaagaggccccctaagaccacagaagataaggaggaaacaatacagaaactagagaccctggagaagaaggaagaagaagtaacttcagaggaggatgaggagaaagaagaagaagaagagaaggaagaggaggaagaagaagagtatgatgaagaagaacatgaagaggaaactgattacatcatgtcatattttgacaatggagaggactttggtggtgacagtgatgacaatatggacgaggctatatactgaagaaggactctggaccctcgtgtctttctttaggatacagagagtaactgtacctattatttgtttcttcagacaagcaaatcatttggtcagagttcatataatctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagcctggttttatacttttaaataaagtgtttttatctgtc

SEQ ID NO: 1243 - DNA, 1229 bp, Homo sapiens
gacccgaggggggcccccacgcccgctctggcctctcaggtcaggccctcccctcccctcccctcccctcccccgcccctgtgtctccgcgagccggctgtgtgcctgcgagagcgtgcacacccgcgggaccttcccttttgttccaccctgacctctaccttctctaccttgtgctgaccccgctggggtgcaggggttcccttcggaggaggccggggctcaaggtgtgcagctcggccgcctctccctaactctgcaccagcgccttctctctctctctctctctctctctctctctctctctctctctctctctctctctctcaagatctccctcctgctaagtctgcgctgctgcaggagggctgggggaagggcaggggtgtggagagggggtgcctggtgtcttctttctctctctgcccccaccaagtgcggacgcatcgagcttcggcccccacccctgcattcgcgattggctcccggaggaggtggctggtgctgccgccgctgcagcatctcctagggagccgcgaccctgcgcccgccgccgctgccgctgtcaccagcccggccccaggggtgccctgggctccgcggctgaggcacctagggagttgcccccctagtggacggcctctcaggagatcctgaccaccctctgggaacctggactcctccaagcatcgtctttctcgcctgcatcttcggagagaggtgctgagcccttcctcatggatacggggtcccgggaggcagccttcaccagggacctgcccaggaaaccagcagatgcccagctgtagctgtgcattgatggcgccgtgcggcccggccgcaggtcccgcagccgtggagaggacccagcaggtggcgcggggagagcccggctcggcacgtggtcagctccaagtcagccctgaaatgtccattactcacaaagaaaaggaaaatgctcatttgaaagaaattcttctctttgtcaatgctgaggcattctctcagccccagccccacagtgctccagtgtgtgaagggcaacagctgacggggaagttcagcacatctgtgctgaccagggctggaggcgatgccagtccgtgcagctgggaacgcctcctctgctatggctggagccactgctgaagggactccacctggcacctatgccaccaatggcccctgaacgggtatctaggcccacccttaataaagatgagctgctc

SEQ ID NO: 1244 - DNA, 1506 bp, Homo sapiens
agcactcccggagcctgcaacgcttgagatcctctccgcgcccgccaccccgcagggtgccccgcgccgttcccgccgccccgccgcccccgtcgcgggcccctgcaccccgagcatccgccccgggtggcacgtccccgagcccaccaggccggccccgtctccccatccgtctagtccgctcgcggtgccatgccattcctcgggcaggactggcggtcccccgggcagaactgggtgaagacggccgacggctggaagcgcttcctggatgagaagagcggcagtttcgtgagcgacctcagcagttactgcaacaaggaggtatacaataaggagaatcttttcaacagcctgaactatgatgttgcagccaagaagagaaagaaggacatgctgaatagcaaaaccaaaactcagtatttccaccaagaaaaatggatctatgttcacaaaggaagtactaaagagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacacgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaac

SEQ ID NO: 1245 - DNA, 1452 bp, Homo sapiens
aaccagtcccaagtgctcaggacagaggctggacgggctccttcctgcacccctgctcttgggacacagtgccctccggctctaataggccaggagttgggggggcaactggctctgctccctggccctggctccccctgctccctggggctgcccgaggtgaaggtgacaggtgggggaggcaggtggagaattgggccagtgagctcatggcaaaggcgcccagctgggcaggggtgggtgctctggcctataaagcccccgaggccctgtggcctgcagaggcggttatggacggcaccatggaggactccgaggcggtgcagagggccacagcgctcatcgagcagcggctggcacaggaggaggagaatgagaaactccgaggagacacacgccagaagctgcccatggacttgctggtgctggaggatgagaagcaccacggggctcagagtgcagccctgcagaaggtgaagggccaagagcgcgtgcgcaagacgtccctggacctgcggcgggagatcatcgatgtgggcgggatccagaacctcatcgagctgcggaagaaacgcaagcagaagaagcgggacgctctggccgcctcgcatgagccgcccccagagcccgaggagatcactggccctgtggatgaggagaccttcctgaaagctgcggtggaggggaaaatgaaggtcattgagaagttcctggctgacggggggtcagccgacacgtgcgaccagttccgtcggacagcactgcaccgagcttccctggaaggccacatggaaatcctggagaagcttctagataatggggccactgtggacttctaggatcggctggactgcacagccatgcattgggcctgccgcgggggccacttagaggtggtgaaacttctgcaaagccatggagcagacaccaatgtgagggataagctgctgagcaccccgctgcacgtggcagtccggacagggcaggtggagattgtggagcactttctatccctgggcctggaaatcaatgccagagacagggaaggggatactgccctgcatgacgctgtgaggctcaaccgctacaaaatcatcaaactgctgctcctgcatggggctgacatgatgaccaagaacctggcaggaaagaccccgacggacctggtgcagctctggcaggctgatacccggcacgccctggagcatcctgagccgggggctgagcataacgggctggaggggcctaatgatagtgggcgagagacccctcagcctgtgccagcccagtgaatgcgtgccccagcccagccagctacccagcccctctctgtgtgcagccggagggtcctaagaatggctcccggagctaactgagggcccagccttttttctgcatgatccaggagcacataccacaaactaccacaataaaaaagctgtttttgctaac

SEQ ID NO: 1246 - DNA, 1830 bp, Homo sapiens
aagaggactccaagcgccatggccgctgccgcccgagcccgggtcgcgtacttgcttaggcaactgcaacgcgcagcgtgccagtgcccaactcattctcatacttactcccaagatggctgtttcaaatattagatatggagcagcagttacaaaggaagtaggaatggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaagcttcatggaagctattgagtttgcccaaaagggagcttttgatgcctatgttgctgtcggtggtggctctaccatggacacctgtaaggctgctaatctgtatgcatccagccctcattctgatttcctagattatgtcagtgcccccattggcaagggaaagcctgtgtctgtgcctcttaagcctctgattgcagtgccaactacctcaggaaccgggagtgaaactactggggttgccatttttgactatgaacacttgaaagtaaaaattggcatcacttcgagagccatcaaacccacactgggactgattgatcctctgcacaccctccacatgcctgcccgagtggtcgccaacagtggctttgatgtgctttgccatgccctggagtcatacaccaccctgccctaccacctgcggagcccctgcccttcaaatcccatcacacggcctgcgtaccagggcagcaacccaatcagtgacatttgggctatccacgcgctgcggatcgtggctaagtatctgaagagggctgtcagaaatcccgatgatcttgaagcaaggtctcatatgcacttggcaagtgcttttgctggcatcggctttggaaatgctggtgttcatctgtgccatggaatgtcttacccaatttcaggtttagtgaagatgtataaagcaaaggattacaatgtggatcacccactggtgccccatggcctttctgtggtgctcacgtccccagcggtgttcactttcaccgcccagatgtttccagagcgacacctggagatggcagaaatactgggagccgacacccgcactgccaggatccaagatgcagggctggtgttggcagacacgctccggaaattcttattcgatctggatgttgatgatggcctagcagctgttggttactccaaagctgatatccccgcactagtgaaaggaacgctgccccaggaaagggtcaccaagcttgcaccccgtccccagtcagaagaggatctggctgctctgtttgaagcttcaatgaaactgtattaattgtcattttaactgaaagaattaccgctggccattgtagtgctgagagcaagagctgatctagctagggctttgtcttttcatctttgtgcataacttacctgttaccagtataggtgggatatacatttatcttgcaggaaattccccaaagctcagagtccagttccttccataaaacaggctggacaaatgaccactatgttagacccccaggctcgacttcaggggtcagtgttcctgtcccaaaccccacacagaatactctgcctctgcttcatgtagcaaatgagcaaaaactcagtatctatcaaaagtgtaaattatatttcctatgcctagtaattcacttcatgtctaaaaatttatctgatagaaacactagcaccagtacatacagaagcatggcaaggatgtttctggcagcacttttctaataataaaagatttgaaac

SEQ ID NO: 1247 - DNA, 1234 bp, Homo sapiens
gcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtg

SEQ ID NO: 1248 - DNA, 1380 bp, Homo sapiens
acctgacgctctgctttcccctgacctccactgacatctacgacccgccctggaggcacggaaggctgtggggttccagccccccaaactgtgcagctgaggaaaatgagccgtgaatgggggcagagccagatcctgggcgggaccctgcgcaggatgaactcaggcagccagagggaccccgggaagatgggagtgagagctgccttcgtctgcaaaagtctccagacaccacctcactggtgaaggccagagaccctaaactgtcccaagaccacctgactgggctgcctccctgccacctggctgccagcctctctcagagcgcctgcaagctattcctccaacccagagtttccttcccagctaaaggcctttgcacctgctgttccttctgcctggaagttcaccgcagactatcccagggcctccatccttcccattgcatggtccccatcagctgccgccgcctctgagagctcagtctccactggccatcctgtctctcagcccactgcactctccactctgccagaaagtcccccaatcagtgacaacacaggtcacggtccacacctcacctggtttgtccccagtgcccagcatctggcaccgagcaggtgcgtgcaaatcctggacaggtgggcaagctgatggtgtccagaggcccctggtccttaagggcaggggtggggatggctcagaggacataaccttgcagacccgggttcaaatctgggctcctcagctcatttggtcctcacacagcccatgttgggagagctagtgttctccctgttttgctgatgagacacagagaaggtcagcaactcccgaagattgcccagcaagttgggagtaaagctggtgcaattcccacgtttagctgctaaacagggtgtcctgtacttggtgtgttcaagcagaaatccacacatgggaaggtcaaggcaacatccctggtactccagctttgaggtcctaggaaaaagggaacctcccattaaatgcttctattgccgggaagttcagcacctgtaaaagcagccccttcccgtttcactgtggctgcattttaattcttattttttaaatgtttagcttaaggccgggcacagtgactcacactataatcccagcaatttgggaggctgaggcgggaggatcacttgagcctaggaattcaagaccagcctaggtaacatagtgggaccctatctctacaaaaaataaaaaattagccagtcatggtggcatgctcctatagtcccagcttggagattgaggtgggaggatcacctgagcctaagaggacaaggctagagtaagccctgatcccgccagcaccccagcctaagtgaaagagcgagagcctgtctc

SEQ ID NO: 1249 - DNA, 1173 bp, Homo sapiens
agcggcaggcgaagggggctgaggaaaggaggtgggtctaggcaggggaaattggggtgccaccagacggagacagcttggactaccagaatcaagcactcttttggaagagggtaatctctctccaaaactgaggacacttaccttccccatatattgagtccagctgtgtttggtggcccaggtactaatttcaagatgccaggacgttccagttcaaattcaggttcaactggtttcatctccttcagtggtgtagagtctgctctctcctccttgaaaaacttccaagcctgtatcaactctggtatggacacagcttctagtgttgctttggatcttgtggaaagtcagactgaagtgagtagtgaatatagtatggacaaggcaatggttgaatttgctacattggatcggcaactaaaccattatgtaaaggctgttcaatctacaataaatcatgtgaaagaagaacgtccagaaaaaataccagatttaaaattattggtagagaagaaacttttggctttacagagcaagaattctgatgcagactttcaaaataatgaaaaatttgtacagtttaaacaacagctgaaagaactaaagaagcaatgtggtcttcaagctgacagagaagctgacggaacagaaggagtggatgaagatataattgtgacccaaagtcagaccaacttcacctgccccattacaaaggaggaaatgaagaagccagtgaaaaataaagtgtgtggccacacctatgaagaggacgccattgttcgcatgattgagtccaggcaaaagcggaagaaaaaggcctattgccctcaaattggctgtagccacacggatataagaaagtcagatcttatccaggatgaagcacttagaagggcaattgagaaccataacaagaaaagacatcgtcattccgagtaggaaaagccacctgcctgcagggacaccagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgtttatttttaagtgttctataatgttaaataaaactttgatcatc

SEQ ID NO: 1250 - DNA, 1568 bp, Homo sapiens
agttctagcctacccggcagcctggacgggagcaaggcgagaggtgctgccgcctcccgtcgcccctgcgctcagaggtcccgaaccagcccagccgctgcctcttgccgctccgcctttggagtgaggagggcgcagcccgcgtcagaacttagagggccaggcagggtcgcgcgcatggcctgggcgggctcgcggcgggtcccagctgggacgcgcgcggcagccgagcgctgctgccggctctcgctcagcccgggcgcgcaaccggccccgcccccaggccctccgccaccgccgcgaccaatgaggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccctggtattcctgcctatcctcgaacctgcactgtggacttttcgatttcctttgaatttcgttctctgctgcgctcccagctggccaccatgttttttgatgaggctgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtg

SEQ ID NO: 1251 - DNA, 1054 bp, Homo sapiens
ctcgttcttgccagggccgcggttagtccctgctggccaccccactgcgaccatgttcgttccctgcggggagtcggcccccgaccttgccggcttcaccctcctaatgccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaagtgtattcattgccttcaagaaagctggtggctctacagttaagatccatttttattaagtataaatcaaagccattctgtgaaaaactgctttcctgggtgaaaagcagtggctgtgccagagtcattgttctttcaagcagtcattcatatcagcgtaatgatctgcagcttcgtagtactcccttccggtacctacttacaccttccatgcaaaaaagtgttcaaaataaaataaagagccttaactgggaagaaatggaaaaaagccggtgcattcctgaaatagatgattccgagttttgtatccgcattccgggaggaggtatcacaaaaacactctatgatgaaagctgttctaaagaaatccaaatggcagttctgctgaaatttgtttcagaaggggacaacatcccagatgcattaggtcttgttgagtatcttaatgagtggcttcagatactcaaaccacttagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagt

SEQ ID NO: 1252 - DNA, 1109 bp, Homo sapiens
ctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggaagagcgttcgcggagcgaacacaacttagtgaacatccagaagacccatgagcggatgcagacagagaacaagatttctccctattaccggacaaagctgcgtggcctctacacaaccgccaaggccgatgcagaggctgagtgcaacatccttcggaaagctctggacaagatcgcggaaatcaagtctctgttggaagagaggcggattgcggccaagattgccggtctctacaatgactcggagccaccccggaagaccatgcgcagaggggtgctgatgaccctgctgcagcagtcggccatgaccctgcccctgtggatcgggaagcctggtgacaagcccccacccctctgtggggccatccctgcctcaggagactacgtggccagacctggagacaaggtggctgcccgggtgaaggccgtggatggggacgagcagtggatcctggccgaggtggtcagttacagccatgccaccaacaagtatgaggtagatgacatcgatgaagaaggcaaagagagacacaccctgagccggcgccgtgtcatcccgctgccccagtggaaggccaacccggagacggaccctgaggccttgttccagaaggagcagctcgtgctggccctgtatccccagactacctgcttctaccgcgccctgaaccatgcgcccccacagcggccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctct

SEQ ID NO: 1253 - DNA, 1699 bp, Homo sapiens
aagtgtgggcgcagccgggacaatttcgagacaacttcgagacaatttcgaatggacaaattgcggagaagttgcttctgccgctcagaagccggttcacctccttctccaccgcggcatttccaaaacaacagggacaagtctccccggctcgccgcaggcctgaccgcccagctccgccaggatttgcagagagcagcgcgctccatttgcagaaaggaaatcgagactggactccttctgactccacgcggccccagctcctgaaccagcgcagtgagcctcagccgcttctcaaactgggtctcagaaaatttctcctcgagatggatttcagcggcaggaaagaggggccagtgacgcgaggagcaagaaaagagtaacatgggagatgaatgttcaaacccagatctcctcgctgagcctggaagctcgccaccgtgggatcacgggaaccagaggcaagaggctgcgaatgagtccaacacccgcgttcctcgagttttaaaagcacacctggggccagagactgcacagccaactaaacggagtaaacgcaacaggtggaggaggcagagttgtcaggggccaagcccggcgcgatctggccagttcttggggagcgcggacctgggactgcagagaggcgttttgaagagtgctgcgcgcacctgcctctcggagatatccaactccacccgggcgtctcctgagagcgcacagtccacagaccccgggagggctgcccgccctaggacacgtactctcccgacccctcactctttcaaaattggggaagaggcggaggagatgaaaaagaagaaagagagaaagagaagaaaagagagaaagaaggaaagaaattttaaaaaataataaaaggagggaagaatggaggtaaaacgcgggggagagaagaggggagaaactctcctcaccacaaccaaagcaggaggcctaagcttcctgaatttctacacatgacttgcattaagttccttcctagaacttaaactttttcatctcccgtcacccaagaaaacacccatttcctcttttaaataaagtttctttttctggagatgaacctttaaataagtcgtacgtttgggagcgagggacaggagaataattttgatccagaaccttggagattggagaagcaggtggaaaaattctaaaaagatgaaaactgaccatctccgacacagaaacccatcgaaaggggccaccgagacccgttgattagctggagggagcatgcggcagaagtgcagacccctcgctaacccgccaacctccaagagccctcttgcagaaagctgcccggctccccacggtggccctgcgcgcgcaccatcctcgcggtctcgcttcttcgccccggaaaactctatgaggggcaccccagcctcagccgggttaagacaagtagccccaagaggaaggagcctcagagagcctttcttcctgttcttcttcgtcttcttttttttctaaacgaaatctaatactatctggctgcaaaaatatattatcaccggctctcagcctaagagactaacatttggatatgtaggaaatgtaatctgcatggctaattgattctcagcgtatcagtttaaaggataaagatcgatatctacatgatggatattgtattaataggggcataaataaaggtcgaagagtcgttacc

SEQ ID NO: 1254 - DNA, 1622 bp, Homo sapiens
acagtgaagcggaggcagagcggctccgcgagcttctctccactttcccatagagaaaccctgactggccgctgagggctagctacacacacgccctcacgcccggcgagcccgcgaggtcactatcatatgacaaaggctttgccgcagttcatcttcctccctgtgtactttccatttgccttcctggaatcctgctgcatcacagaagctggaagttctgatgttccactgaaatcacaatggaaagtcttgacttgactggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctgatcctactcaaatgggaggcctgagtatgctgctgttagctggagaacatgctcttggcacaccagaggtatcctctggcacatgcaggcctgatgtttcagaatctcctgaattacgtcagaagtcaccattgtttcagtttgccgagatatcttcaagtacgtcccactctgatgcttctacaaagcagtgtcaaacatctgccttgtttcagtttgcagagatttcttcaaacacttcgcagttgggtggtgctgagcctgtaaaacgctgtggaaagtctgcactctttcaactggcagagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagct

SEQ ID NO: 1255 - DNA, 1239 bp, Homo sapiens
actggggggtgtgaggaacaggggggaccatggacttcatcagcattcagcagttggtaagtggagaaagagttgaagggaaagtgttgggatttggacatggagttcctgaccctggagcctggcctagtgactggaggaggggcccccaagaggctgtggcccgggagaagctgaaattggaagaagagaagaagaagaaacttgaaagatttaacagtaccagatttaatctggataacctggctgacttggaaaacttggttcaaagacggaaaaagcgactgagacacagagtcccccccaggaaacctgagcccctggttaagccgcagtcccaggcccaggtggagcctgtgggcctggagatgttcctgaaggcagctgctgagaaccaggagtacctgattgacaagtacttgacagacggaggggaccccaatgcccatgacaagctccaccgcaccgccttgcactgggcctgtctgaagggtcacagccagctggtgaacaagctgctggtggcaggtgccacagtggacgcgcgagacttgctggacaggacacctgtgttctgggcctgccgcggaggacatctggtcatcctcaaacagctgcttaaccagggagcccgggtcaatgcccgggacaagatcgggagcacccccctgcacgtggcagtgcgcacccggcaccccgactgcctggagcacctcatcgagtgtggcgcccacctgaacgcaccgtctgtacgtttcaaattacactggtgtaggcctgtactgctggtggggctgggcccctaaacgccagaaagtgaatcttaagaagctctgccctaaactgagaaccacatgctgagggaagggctgaaaggtgaaggctcagcctccctcacatgggtcctgggttacattaggtaccgggctgattgataggcatttggccatggttccttttcgtctacctttgggggccttctcaggcccagaacaaggctgttgttactatgtggaaaagctgaccagtgctgcacactaggggcacacacctttccatgagcagctcctgccctgtggcgacagccagcgtgcacccagacgctggtgccatggcgaagcaggcgttcaagaccatggagaagacaactcctcatctagaaaatgaggacacctcagtgacaaacacacctttttataccaatcagtatcctctgttcattaaaactggctatccatt

SEQ ID NO: 1256 - DNA, 1643 bp, Homo sapiens
atttcagccctgacaccaaggcaggaggctaggaggtctacaaatagcgactgggtagctggtgtgaacacagggggtactgggggggcttagcccccaaggaagaggaccagtttttccccagcaccaccatcaaggcctcgaggctcccagctccctctacagcctgtggactgacttagggaatcccgaacgatgacagaaaaggaggtgctggagtcccctaagccctccttcccagcagagactcggcaaagtgggctacagcggctaaagcagttactcaggaagggttctacagggacaaaggagatggaacttcccccagagccccaggccaatggggaggcagtgggagctgggggtgggcccatctactacatctatgaggaagaggaagaggaagaagaggaggaggaggagccacccccagaacctcctaagctggtcaacgataagccccacaaattcaaagatcacttcttcaagaagccaaagttctgtgatgtctgtgcccggatgattgttctcaacaacaagtttgggcttcgctgtaagaactgcaaaaccaacatccatgaacactgtcagtcctatgtggaaatgcagagatgcttcggcaagatcccacctggtttccatcgggcctatagttccccactctacagcaaccagcagtacgcttgtgtcaaagatctctctgctgccaatcgcaatgatcctgtgtttgaaaccctgcgcactggggtgatcatggcaaacaaggaacggaagaagggacaggcagataagaaaaatcctgtagcagccatgatggaggaggagccagagtcggccagaccagaggaaggcaaaccccaggatggaaaccctgaaggggataagaaggctgagaagaagacacctgatgacaagcacaagcagcctggcttccagcagtctcattactttgtggctctctatcggttcaaagccctggagaaggacgatctggatttcccgccaggagagaagatcacagtcattgatgactccaatgaagaatggtggcgggggaaaatcggggagaaggtcggatttttccctccaaacttcatcattcgggtccgggctggagaacgtgtgcaccgcgtgacgagatccttcgtggggaaccgcgagatagggcagatcactctcaagaaggaccagatcgtggtgcagaaaggagacgaagcgggcggctacgtcaaggtctacaccggccgcaaggtggggctgtttcccaccgactttctagaggaaatttaggcgtgcgggcgcctgcaagcgggagacacccacaccccattctgggcgggcccagtggagtttggggaggggggcgaaagcaacgggactgctgggagaggaggggtaggaaggcccgcctgagcgcgacggggcttccgggaagggactggttctcgcccccttccccagcctggggcctcggatacctgctgcccagagcagcccggacccgaaacctttcaggccccgcttgcaagagctggaaaaaaacgcgtatctactaggaggagccagggactggggcggggggcgggggcgagggagggcgaactgtcgaatgttgcgaatttattaaacttttgacaaaactt

SEQ ID NO: 1257 - DNA, 1369 bp, Homo sapiens
aaagcttgtttggacgaccttcgtctgggatgcactcttcttctccttcacctacaaatgatagaggattacgaagaactatacggttggctcctctttcctttggccttaggtttctgacctcctgcagcctcctcttgcctcgggctgcccagatcttggcggctgaggctggcttaccttcgagccgttccttcatgggatttgctgctcccttcaccaacaagcgaaaggcttactcggagcgtagaatcatggggtactcaatgcaggagatgtatgaggtggtgtccaacgtccaggagtatcgtgagtttgtgccctggtgtaagaagtctctggtggtatccagccgtaagggtcatttgaaagcccagctggaggttggctttccacctgtcatggaacgttacacctctgcagtttccatggtcaaacctcacatggtcaaggctgtttgtactgatggcaagctcttcaaccacttagagactatttggcgattcagccccggtattcctgcctatcctcgaacctgcactgtggacttttcgatttcctttgaatttcgttctctgctgcactcccagctggccaccatgttttttgatgaggttgtcaaacagaatgttgctgcctttgagcgtcgggcagccaccaagtttggtccagaaacagccatcccccgtgaactgatgttccatgaggtgcaccagacttgaggcaagggattgctccctgacctcccttctaccccacttccctacacaattctcttatttatttggtttggctcctgttccaatttgaaaggagtctgtgttcataatactgtttctcctctcaatttcccagaaattgggttctatgctggctggaaatgttgggggaaagagaaggcaaaggatgtggaaatgagatgtgcttaggaaagggtcaggcccatcgtaggagcaccatatgcctgcagccttttcactacgaattagaataaggactatgtggttgtctctggaccttatcaagacaccttagtgtctgaccaggggacgatagtaacttttctaaggattgaataaattgagcttttcttctggcacagaggtactgagtggtaagtaacttttaccctgcctgagattcctcaggagaaaaggcaacctgcctccagcctgaaatacataaagcctcattttaagactgtaagtccatgctgcctggctactagagagcaaggggctttcttaccaccagtgctgaggagaaaagtactgaacggaaacggagttgtctttgtactcttgagttgtaccttattcttccacttggcctgagtttttataaaatttcaataaattgtgacagtgtg

SEQ ID NO: 1258 - DNA, 1884 bp, Homo sapiens
tcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccgcatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttctttacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgcacttagactgtcacttcgtgtggcctccaggtcttaccggggcttccgggaggctggctgctttgctcagagagggtgggaagggggcctggagagacacgagaagcagaggtagagcctagaaggtggcagcaggtgggtaagaggcttatttagcacattaggggcagtgagcacctggaggaaggagggcgctcccaatcacccgtaggaggccatctgcacaccaagcggcaattcacctgctggcgcttttcctaggtgacaagcacaatactacagtcttcacactgtttacagccctgggcaccagccacccggcactggctcttcatcacagctctgctcttgcttagctagtggggtgggggaaagggcagggatttgtttttttaattgggtggagagccaaacagctactgtccctgggtgccaagcaagccagttttttggttccctgagggaaactgaccctcctctcttgtggcaccatccagcctcagggtcttggagacttgagtaagaatgtgagtggagggggagaggtgaggagaggagcacagggtggatctgtggagggaagaggttacagggggaggagctgatgatagatcccacccagacttaagctgctggtgggtgggtgagctgggaagtaggactgtccagggaagggtggagagatgtagctaggggctggggagggggaggtggaagcgctattgagcatcctccacaccaaggttgatgaaggaagggatcccagcagggtttctgctctggggctggcaggttgcctggtattatgcccaaggccgctctgcctgggggaaagggcagccaggcagaggcccagtgtctggtaggctgctgaatttcctggaaggggtgattggatggaaagaggccagaaaccccagcctgagagactgctgtgcaccccacagtctgactgcacagagccgcctctgttggcaggaggcactgaggctccccttcctgtgtattgagaagcagtgtttgccaatatattttgctttcaattccaagaggagctctgggaaaacctgtggataaaaccatgccaatgttggacgttgtttccttttccttttctctctctgattgttttaattgttctgtggtggttttaatggatttgagaccctggagcggcagctgcctttctgatttccagctgctttttgtgaataatttaaaaagaaaaaaaaaaaagaaactttacattttggagacaaacctgtgtgagttttttattggtacaaacgttgtatttaacactaggggttttgtacagttttttgccttttctactagaaaacaatgtaaagtgatttcacaatgtg

SEQ ID NO: 1259 - DNA, 1821 bp, Homo sapiens
aaaatacacgttttctccttttgaaaagcaagcaatgcttaagcaaaataccttaaaagttaactaaaaagcttttctaaaataaacaactctgcttgtgatcctaaattgggaccacatgtagatgtgaaagctacaaatgcagtgcactcagaatttgtgtctctgccttcactgtttgcgtgcctctgagtagatgatgataatgttggctttggtccccaaggagcctgagttttttagatcctagtatgagggggaaaagcagaagaagaaagagaaggaatgaaaacaaatgcctttcaagacaaaatatccgaatgggtttcattttgcttatctgccaacaggctcaacccaatttagatctctcctacaaggacaggatagtgccagccagggtgtctgcccttgccggctatgtggggcagtccctgtgagggaccaggctcgaattcagagcagaaggatcactctagcaaactgccagggccagccctctgccctgaggcaagtcaatgaattagccaattcagcacagatagaatcattcctttgttttcctcaattaccaaatgctgtgtgctttgggggtcacttgtcatgtgagtttagagaatgtggatattgcaacataaaccctcaccattctaaacagcttaaactaaattctgttactggggaggagagctgaggtgataatatccatctctaagtataaactattgtgtgttcattttcccattatgggagacaaatttctcttctccgctagtgctcatgatctcttccaccaggcacaaacatcagatgtgtgtttatgtggacatattttgtcccctattattggagagcaagctccttgagagaagggattatgctgcctggatttgtaactttgttaggcaaagcatgactttatttagttttgaattgatgaggaggcactgatgttagtaaaaagctcaaatgtcctgagccctgttgctcaatacctcaaacacaggaccatgatcaccacaatgaaaaatatgcaggatcattaatttcggctctgttaattgtgctgttaggaaatgttgactagataggaaaagcagctaacgttcatggagtgcttattacataccaggtactgaggtaagcattttacatacagtatccgatttgtatcctcccacaagcatgttatccccgggttaaaaggggaggaattggggtccagtgagattgggaggttatgagaatcccacagtgtgtggcagaatgtggacttgaactcagggccctaacaacaggaagctataaaagcctctttgtataaaaagtgctctctttctgtgggtcctcagtaaatgaaaatatttgcttttcataaataggtttgaatgttgggaccctcatttctcaccaggagtcaaggccaaaaggtcttataaataagagtgaattttgagaaaggatgtgtgaaaatgactctgttcttttcttttatctcacttcagttacttgggatggaggaagcagaaactgggagtcagacatctaaaatatgaagttccaccctcatgttggccatttctttcagcctcctttccccattcctaggggccaatctgtttctccctctcctgctctttctctttgcctctgtcttcttctttcctgtggagacaatagcgtgtggtggaactgcctgagtgcttactgagaaggagaaaccaagcgcagattgtacagaagctgacgaatgagtcctctgattgtggacaagtgatggcgctttttgtaaaattgtgtatgtgtttacctcaagtagtg

SEQ ID NO: 1260 - DNA, 1853 bp, Homo sapiens
tatttgtgtgtctgcacatcactgtgtttatgcccatgctgtgtgtgtgcctctgttggtgaggatgtgtacacatctctgtgtacatgtgcatttgtgaaagtcttgtgcagggtgagatgttgactccaaggcaagctctgggcttggttttcccctctgcatggggagcctcctggctgcttggggttccagtaaatgcttcctttggacacatggggtatcaggtcatcctccagtggcagccaaatcagacattttcatgtggacaaggcgtctcctgctctgggaatgctgcttggacaaccctcagcaatgaacgaaccaggactcctgcttggagctggccttagaaccacccgctctctcttcctttagccaggcaatcactccgtgagtcacttcaaaaacacacatggggtgcctaccacagaccacccttcatgctggggctctggagagactgagacgggtgtattagtctgttcttatgctataaggatatatctgagactgggtaatttataaaggaaagaggtttaattgaatcacagttccgcagggctggggaggcctcaggaaacttacaatcatggcggaaagggaagcaaacacttccttcacttggtggcagcaaggagatgtgcagagcgaagccggggaaagccccttataaagccatcaaatctcgtgagaactcgctcactaccacgagaacagcatggaggtaaccgcccccatgattcaattacctcccagggggtccctcccatgacatgtggggatgatgcaaactacagttcaagatgagatttggttgggaacacagccaaaccatgtcagacaggaaaggcaggcatgggggaaggggcgtctttgggagaagccatagtccaaagccacggaaagaggccaccagcagtgagtgtcctgaaacatcacagggctctgatggacgggagaacccaggtctgcggaggcacaggtgggtggggcacatgggacagggctacctgggcaggcagaaaagttcctgagggcggaaaagttgcatgaacttgggcctggagtctgtttagagcaggtagtggtgggtggtaaggactgtctcctattagtgatgcctactcactgtgcaaaatgaagaaaagcagatgaacagaaggagtagagtaaaactgaaatccaatcccaccaccattcagaaatagagttgagatggtgatatttttttctgtgtgtgggggggcgtgcatttttgcgaatcaaattgggatcacgcagctatattatttggcaacttgctttgatgttcatgcaatacaatgtgccatgaacatttttccatgttgtaagcatagcttggcggctccaagcaggaacagtgaagtcctgggtcaaaatcggtccaaccacttggatcaggtagttaccatcttctctgagcctcacttcctgtatctgtatgaggagagaaaagtgaggcctctatcaaagggcaggccagagccccctgcaggaccagctctccagctcagccttgcctcaccccactccaaccagcggccattttcctaagtacctggcagcttctcccttagcctggaatgcccctgccccacttgcttggacgacacttactcttctttgaataatcagagcaaccttgaggattaaatgaagcaaggtgatgtatatagacagggtacctagcgcaatgaccggcacatctcaggagcttacttttctacagtatctttgttgatggctgctgaatgtatgatgaatttccctattccaatgtatgatgaatttccctcatttgctcaataaatctctattgctggacattt

SEQ ID NO: 1261 - DNA, 1724 bp, Homo sapiens
catgtgggagagagagagcatgagagcacagtagcccagcctgctggtcagcaggctcatctgtggttcacctgtagacagagagcagatcaatgtgtacttcagacaccagaaagtctggtggctttggtcccaagtgggaaaagagaactgccccatgcccagcttgtgattatcgtttttggagacctgaagcccacactcgggtcgtatggacttctggaaaagttcttgtctcctggactgaaccatgtgaccggaggcccctttcctagtctcatcctcccctggctgcagatgcttagctgggccagggattgacccaagcgcgatgcagcaggcaggctcagaagacgatgcggggctgtgtgccggccttcttgctgcatgtactcagcctcgggagagcttgctgcacccaggccgcccaggtcttcacagcacaactgcctggaaggcaggttgcgagaaggagaggcggatggcatgagcagcaagggggaccgatgctgtgcagctcacaccactccagaacctgacaaggcaccagcaggaccccttgccaggagcatgtctgtgcagcagtgtttttgcccctgcacattccagaagccctcatgggaagggatgcagccaggcagactcctgccagatggggcaggtagtttattcaaagagaactctgtatcccataggcccaggctctcctttcgcttggcgtgggctttgctggcccagtgtgtgctcctggctcagcagaaacatccatttgagttggcatccctgtagggatcccagagcgttgtaagccttcttgtgattggtagggatggctgtggggtggcttccaggagggggccaccattgccgcatctacttctagactcccaaaggagcccaggctcaggcaggcctggcccagagtcacgctggcaaccacgagtttgggaagcagtcgtattctctctctctctctctctctctctctctctctctctctcagtatccatgacaggtatgaaacatattgtctctttataaatgtcattttacaaattatgtgattatctggaagctctaagatgagagcaaatgcctgatcactctggccaaatgtcagatactaaagcccattcttggccgggcatgttggctcccgcctgtaatcccagcactttgggaagcccaagtgggtgaatcacctgaggtcaggagttcaagaccagcctgaccaacatggggataccccgtctctactaaaaatacaagccgggcgtggtggcgcatgcctgtggtcccagctactcaggaggctgaggcaggagagtcacttgaactcgggaggcagaggttgcagtgagctgagatcgcgccattgcactccagcctgggtgacagagcaagactctgtctcataaataaatacaaagcccattcttccagagtcttgtgccttaaataaaacacacctctctgctgtgggaagactgtgcaatggcacagccgcagagcttggtttgggaggttgaagtgctctggggagaattcgtagatcatcctcagaaaagccttgccctggtgttctaccagaaaaacgtctcccaatcacccaggaaagctgtccacagtagtccccccttatccacggtgtcactttccatgggttcagttatctgcggtcaaccacggtctgacaatattaaatggaaaattcttcaaacagt

SEQ ID NO: 1262 - DNA, 2536 bp, Homo sapiens
tgtttaggagggttttcctatctacctttctactgaagtagtttctggaactttcctggtggatcagagttacgtaatgcagtctgagccttcagactgctagttagaattgttttaggtgttcagaaagggcaaaataggctgatgtggcctgtcagagtgatgtgttctcaaaaaagttcacttgcacatctgtgggctgcttttgtcctcagacccttagtggacagactccacaaaccctctgatgagacgattgatgtggccagggtccagttagcatcagtagaaggatgtcactaggaaaggcccaggtatctggtaagtgactgtgaggtgtcacagtacctgtgacaggagagtgtcctgatgtgcttgggagaaaggccgtatgggggccagggatggaagagacagtgtgtggccacagaaattcctgtccatccaccaccagtgctgctccctgtgtgggctctagggcgagtggccccgaaccttggcccagtgctttgtcccaggccagagtcttggcaatgccacatgctggcagctttctcactgagaaggtcctagcttacccctgtgtgctggccttggattcagccccgagagaggggagagaccattcctcctgtggagtgggttccttatcaccagaccggccactctcagaactggcgtccactgtaaatccaggtgccttacgtgtggctctgtcccttatgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgatatttgagtattatctgggatgtggttctggagctgcccagagctgtgcttagtagagtgtgtcttggaaacatgcccctgggcacactgtatctgctacattagtgggctatctcttatctgcagtgttcgcttttgctagaaagaggatgtggaggaaggaggaggtgggcaatctggcttgagttgtgctgtatcctcttccttgttagcttgccttagtctcactggagaccatttgcggatagtgcttggtccatgcccagcaggacagggctttgctgcttctgaaagtctggtgttctgtatctggggctgtgggttcctgtgtctagctgctcaggaaatcttgagaagcattccactctggggtgtaaaccagtatgagtttgaaattcaagcgtttgtacctgagttggggagagaattgcaaggcatactttctctgaaagtaacagaaccattcaggctgccatgttattaaggaatctgaactgttgatagcagttaccttgtgggtgatacaatgggaggcggcaaaaaaactacctgcataggagaccctgccctttgtcaagagctgggagcacatttcatcagagtagcaggcccacctggtgccagagggcctgcccctcctgcttctgttcctttgccttgcagtctcctggagagagcctctcttttcctgtacagcctttgggccaaaatgcccttctagcttctccaaagaagatccgagtttatttcattctatgttttaagaggtaaaaggacataacaagtgaaggaagttttgggctaaagtaggctatgtctccttatgtattactcaatactgttttgcagagaaaacatttttcaagcatgtgcttcctgaagacacctcagtctttgggccatttgatttccaatacatagggtggaagaatgtgattttgggactgaccataaactggaaatttgtgaaatggcagtgattgggcaatcttcagtttattttttcagttgaagtggaactcatttctggaatggatttaataggctgtgtctaatgtacaaactgggtgagtcctgccttagtgtgtcctgccccaccggtacgcttccaggatactcttttcccctctgtaaagtcactttcttctgatggccagtgtcactatgatgtcagtgaggtctggggatgaggacagtgtgtcctgaaattcacaggactgactcctcaccccagtgcacgaggattcctgtggcatcaggtgctgctgtacctggtgtaggagcctaatcattgaaccattgtgttactcacattccatgtcacagaacatatcagcctcaagaaggatttggtggaggtggatttaccactggttttacaaaggaccgtgtaaagtcattgaagttgtgaaagtctattttttttcctgtaaatctattttttacagaatatagaaacatcaatgacctgatctgtccttcctcctccttcccgcttcccccaaaatcacattccagtttttattgtctttgtgtccaaagtaaactaggtgacttatttgtataaaatgttattttgccacatgagacagtaataaaagaaagattttcacagt

SEQ ID NO: 1263 - DNA, 3075 bp, Homo sapiens
accacctgcttttgtgtgcccaggtcgaccccacctggatccgatcatccacaaccgcaggttgctggaacctcccagtgcagcctggcctgggggcagaggccgggcccagctgtccctcggggttcactgtgctgactccctgcttctgggcctgcctttctctttcttggttttctttataattttgtggtttggagaagtcctgcctcccgtcgtttcctgggccggtcccgggaggtagcacgttgaggcctttcatgtctgaaatgtctgtcgcttccctccgccggaggggcagcctggcctccgtggtgtcacaggtgcagagcctgcccttgaacgtccctgccgcttttgcgtgactgatcctctgtgtgccgtcagctttgcttgaggttttagggtctttgctccctcccagctgtacctggctgtgctgggggcctttttaggctttgggcttgtgtccttcatcgtggggtcatcctctcgtgctctttgttaacttccccatcatcatccctttctgttgctcctgttaatcagatgttgatcctcccgagcctccctgctccacatggcccctgcccagccctctccatccctcttgaaggtagttccacagccagacaccctcccgccccccgctggcctctcctctagggcttgctacccacccccatcccctgcttccactgccacccgatgtgtccacgatgccccaggccacctccccacctctgtggcccctgagcctgcacggaggaaagggtatcctctgggcaaggcacagccacccgccaggtcctccctctcaccacatccaggacagtggacgctgctccctgcctcttcctcagagtcctggggtcacacctctacctgcgcggctctcgggggccacccctctcagccccatccggctcctgagcagctttgtccccagagggccccgggtcattcctctgaccaaccaggcacggcgcaccctgcatgcaagcctgggcgggtgctggggacggacgactgacgcagcagacactgcctccctgaaggcatggcaaggtgggacgcttggccgccacctgcaggggcctcacctgaccagtccccagcctcaggaggcggaccccagcagctggagccccagcagagttggggggatggtggcatctgtgtcctgggctctggggccacctcactgtgaggaggaggtgtgggcgttgtgggaggtctcatctcggggccatgctgatctgggctctgagagctggtgtccgctgctcctcccctcccatttctcctctgagagctggtgtccgctgctcctcccctcccatttctcaacaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcggcctggaggccctgcggcagcgggagcacttccccaacctggcgcagtgggacagcccagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccagaaaagattcaagttcagctgtgcttcaagacgtgttctcctgaaagccagcagatttatggggacatcaaagacgtcagactggatggcgagtcccagtgaggcgatgtgggcagaggagctccgagccgcccacccaaggtggcttcacatccacacaggcacttcccatccacctaggtttggcttagcagaaacttcttttcattcttccaaagcatcgatggtcttcgcgtctcctcaggaggtctcccaggaggaattcttggatggtgtcctcatgttggcggagaacagtgctcagagctggcgcttgcagacgcagctgtcgtggggcagggcggtggcgccttcctgacctttggaagacatgacaaagctgcctggacacggacgcccctgctgtacggccacagcacccctgggtttgcagagcacgcagccttcctagggctttccacctggcgaggccccgctctgctcagcacggtgcaaagtgaatgctgctgtcttggagcctgggcacgtttggggaagttcctgcttcaaactgagctgccccgcataggccaggtcaacccacaccaatcttttctggacaggtgctgggtaggccttcctggtctctggccgcctgctgccagggtgtggccatccccagcaaccggagccggccaaaccagaggcctcgctccgcactccacactttcctttctgtgctccttccaagttaaattaaaccccctctccacgattcccacggcaggcgtcattcccgagatgggagccagtccaggggtcagcaggagccagcgctgggcacacgtgccctggctgaggccagcggcatcctgggtggcccaggtccatcctgggcagcaaaggcgtgtccccttctgtcagacagcttcacagagtgtggcttcaccagtcagagggagcagtccggagaggcaagatgaccccaccgggactgcagagcctcctccttactaacaaggacctgtccgcagccgcgaggtccttcactcccaccctgtaattgtggggggagtgccagcaacaggcctgtcccctggcaagttggccacggaacccaccatgcactgcaaggctgtgacagcctgggcacccctgcttctcctctgcttgtacggttcccccaataaatcctattttccatctc

SEQ ID NO: 1264 - DNA, 2311 bp, Homo sapiens
atccgcagcaggggcaggaagcgctcggtggtgaagtagcgcagggtcggcttcggggcgcgcaaagcggtgaggaagacctgcggcggcgggaggagagctgtggccaccgctgcgcgccggaggacgcaccgcccccactcctggagtccagcccggcgctcacctccgccacctcctcagggttctgcgccgcctcgcgaaagacttgcttgctgtgggcgaggtattggtagaagcggtggaaggtgtggatgtccgtgcggtccagcacctcctctgggctgcccaacaccttctccatgaaggcggtgtgcactgggccgcactcgatcaggctcaagctgctggccggagagcaacgagtgggagggggcggacgccagccaggccccagtcccagccccaaccccagtcccagccccaaccacgtcccggcccccgaccgcgagcagcaccgctgcgctgggaagtgaggcggaaagggcgctggggataaccagaacatttgaaacgcgggttcctgccggagcagccctcccaaatccatctgaggctacaagggagccctggtgtcaggattcgaatctagcggggtccctggccgctgtgtgaccttgggccagtcacctaacctctctgggctggagcttccccataacaataccaacacttcagcagctaggtcagcaggtggcacaatgcgtgccatgcgcccagcccaagtgcctggcacacagctaatgtgagccgggcagagagggccagggagatcgccccagagcggctcccgcaggacagggtgctcggcgtctctaggtcagagttaagagggttcggggaacgggggtgttgactcactggaccccaaagggcagcagcagaaccgccagactctcgcataagccttcgagcgcgaacttgctggcgcaataaacgtcattgaaaggcagcccttaggtggggagacgaggttcctgaggcgcagcggccagggggtcatccccgggcagacggtgcccctccaagctgacggcaccccactccaccccccccgcggaacctgccttcaaggctcagctccgcacacaaagaatctggagctgccgaggccactccctaccactcacccatcaatcctcccacgctcccggtcaccaacacgcgtcccgaaccgcgcctcttcatgtctggcaggaaggcctgcagcatccgcacagtccctactacattcacgtccagcacagaggccacggcgtcctcccccagcgcctccagcggccccagcaggcccaggcctgcgttacacactgcggagacaagaggcccgaccagcccgcctcagcatcaccctcagcacggcctgtcccctcgtgctccctgggcctgggaacatgttggtttcaacgcagggcggagaaggctcctaggagcccatatgcttccaggaggctcacccagcacgtccacgcggccctcagtcacgcgttcccgggcagcggccacggattttgagtcccttacgtccagctgcaacgtctccagggatcccggagggcatgccagggcccgggccgcctcccacagccggccctgtgttttcaggtccctcaacgtggcatacactggaggttttgggagaggaggaagatctgacttcccttctggcctccaagggctcctcccttctctccctccctgtccctgcctatctatacctttgaagctctgggatggatctgaagccagacgtacggccaagtgcaggccgatgcccgaggaacagccggtgatgagcaccacggtgcgggccatggtgagactgtggggagaggctggggctctgggcttgatatcacctgcttcgccccgccccgcctgcgggcccccaccccttgttgtgtctcccacgcaatctcaaggataagccttcctgcgggtccctggcccgctctccccaccctgttctgagccaaaacagacatgagcccactgcttggaacaacaaactgtcctggttgctggtcagagggaggggaggctttacaagcaggtgtgggttcccacgtgggcacagagtggccccctgggcagattcccctgggtatgcctctgtgccacaggagcgattatagtgaccgcagtttgctgcagaggctgtgaaagtaaaggcgttgggaggtgggagatgattgtatatgtgctggtttcgtccagggttcctagctcataactcacatgaccatggttacagtcttacgttgtcatgttggggtgcctcaggcctcaaaaaacagcctttcgtctctct

SEQ ID NO: 1265 - DNA, 2630 bp, Homo sapiens
agcagatcaatttccaactggaaaataactatataatgtatgcttattggaattctgccacagcaggaagcttgagtcaaaatgtgtttcccctttgaaaggagaaggaattggagcagcttttcctggaggcccaggatatttcttttctgggtatcttggctgaaaattttgttttacatagagaaaaacgatcttttaagggtcccttttgctgcattatctgtccagtttgacttttttttcagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccctttcccagtggcagctggtgacactaacgattgctactcggttcacttgcccagatgtcttcatatgatgagcaaggccagaagcaaggctagattcgaagtttctgacaccatttccagtttgcacaaaagtcagtattttatcttaaagtggcttgatttccaatagctgaacttgggcagaaaacagcaggccaatgttcctatgtggtttctttgttgttgtttttgtttggggtgggggcaagtacagggtaattcatgagcaagacatttcactgctgtcgaagtctctgggatcccgctgtgggtctgagatggcctgggaaggaccttgtggacaatggttttatctgttctttttgtcactgttaatttctgggctgctgaggttctagaatagaagggctgccaaatgaggtttgctgcaggaggaaagtttaatcccccattccaaaagtccaggccaaatggtgggcttagcctctttgaaaagttctgccttgcccccacaggtgggcacatcctgtgtctcattcaccatgatgcttcctgagggtgttctagaagcccgttccccagtggctgtatccagcctttccttgcatcatcttcctcttgaaggtgaggaagtgaaaactacagacctcccccggacagcccactctctatcacgagcctaacccgcgggaggcggaagagacatccattcgagaactgaagcggcctccgggatgaggtcagaggccccacctgattttcctggtggtggtatccaaaatcttcagtaactaggaaggaaaccagggtctcatggtttaaaagactttgaagcaggaatgttgcatttgacgcctttaaaactacctttttgctgttgggaggagtcgggggcgagccttagcagctgcaccgccatccccatgctggttggtgctgccctgcctctcgtgccgggtgttgcttcagcccagagccagagggctgggtcccgggtcctccacaggtgaccccggtggacacacgcgttcccatcctggcctccgtctctgcttttccacttctacctgcgtgtgggtttgccgccttgtcatcggttgtgtgagtgtcgcagacctttccagagctccggttcactctttccaaacaggcctccctgtcggtggcactgcactcctagaaccttcagtttctacgatggtttgtttggtccttttgaaccaccccaaagaactcaacatggcaaagcaaatggtaaaagcttcccgactgttctactttgggtccgcgcgaagcccactcacgtgtgatctgtgttgcccctctcggtggtcccaggcgatccagccatgccccctgcccctctgcccagatgcttcaggggcccggcttttcaggcttgccctcaccagcggccgtcagccgacactcagggatgtagctaacaccactccgccagtgctttcagtaggaagagctgaggctgcctgggaggcccggggcgaccggaaaagggctctctcaagttctgaaaagagaatctgccaccagatcgaatttcgacccctgagcttgttcggacgtatggtccaaattcagattaaggtggtcacccaacccgagatgtcaggaaaggccttctgcagagaaaatgtccccccacccgccatctgcagccaggtgtgtgccacacggcagccttcccgaaacatagtatggattttaaaaatgtgtttatttttgtttctcaaccactttataacgtattttttaatttattttgtaatgtcttgttttgaagtattgctgctatccttgttatccttcccactgtttttatcactgatttattttgtgaaagttgtacactaatgttctatgtcaaaatcaaaagtatttaatgaaatactagttctatttaatgtggttatggaaccagctggaaacacaaaacaaacagtgattgtacagcaggctgggcccaggaggtcaggttcattttgttacatatgcaataaactcacgacttt

SEQ ID NO: 1266 - DNA, 2731 bp, Homo sapiens
gcagaagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgacaagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctagggactctggccttggtgctggctcttccctgcagacgccgggagcggcccgctggtgctgattcgctgtcttggggggccggccctcgcatctctccctacgtgctgcagctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 1267 - DNA, 2758 bp, Homo sapiens
gagcgaggagccgggagcggggaacagggagtcggggagccgggaaccagggctggcagcggccgccatgagcacggtggaccttgctcgcgtgggcgcgtgcatcctgaagcatgcggtgaccggggaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggagagctctacctggatgagagcaagcagctttacaaggagctaggcttcaagcggctctggacccaggcttctccggagtttggccaagcgacctggtgtcttcgcaggtacaacagcctgagcatcctcccagcagctctggggaagcccgtgcgtgatgtggctgccaaggccaaggctgttggcatccaggggaacttgtctggggacctgctgcagagcggagggctgctggtggtcagcaaaggtggtgataaagtgctcctgcatttcgtccagaagtccccaggcgactacgtccccaaggagcacatcctgcaggtcctgggcatctctgcggaggtctgtgccagcgacccgcctcagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgctggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcgcacagaaacattcgcagcctgcggtaggctcccccttcctaaacccttaaatgcccttagtctgtaagagaatgtccctgaccgaaatcggccagaagcccctctcaggtttattcccaaaataaacctgtctctgttgagcc

SEQ ID NO: 1268 - DNA, 2873 bp, Homo sapiens
gcgttggtctggccggagcccttgggtgaaattgttaggcgtggagagggagtgatgtcttccagactcggtgctgtacccgccacttcgggacccacaacctttaagcagcagaggagcacgagtatcgtgggagctaagaatagcaggacccagtgctccataaaggataatagtttccagtacactatccctcatgatgactccttaagtggttcatcgtctgcatcttcgtgtgaaccagtgagtgattttccagcatctttccgaaaatctacctactggatgaagatgagaagaatcaagccagctgctacttctcatgtcgaagggtcaggtggagtatcagccaaggggaaaaggaaacccaggcaggaagaagatgaagactatcgagaatttcctcagaagaagcataagctttatgggaggaagcaacggcctaaaactcagcccaatcccaaatcccaggcccgtcgtattcggaaggaaccaccagtttatgcagcaggcagtttggaggagcaatggtacttagaaatcgttgataaaggcagtgtctcctgccctacctgccaggcagtggggaggaagaccatagagggtttaaagaaacacatggaaaactgcaagcaggaaatgtttacttgtcatcattgtgggaaacaacttcgttcactggcagggatgaagtatcatgtcatggcaaatcataatagtttgcccattttgaaagccggagatgaaatagatgagccaagtgagagggaaaggctccgaacagttctaaagagactgggaaagctcaggtgcatgcgtgagagttgctccagtagcttcaccagcatcatgggatatctctaccatgtcagaaaatgtggcaaaggggctgcagagctggaaaagatgaccctgaaatgtcaccactgtggaaaaccatataggtcgaaggctggacttgcatatcacctgaggtcagagcatgggcctatatccttctttccagagtcaggacagccagagtgcttaaaggagatgaacctagagtcaaagagtgggggccgagttcagagacgttctgccaagatagctgtataccacctacaggagctggcctctgctgaactggccaaggaatggcccaagaggaaggtgcttcaggacctggtacctgatgatcgaaagttaaaatatactcgtccagggctccctaccttcagccaggaagtactacataaatggaagacagatatcaagaaatatcatcgtattcagtgtcctaaccagggctgtgaggctgtctacagcagtgtatctggccttaaagctcacctgggctcttgtacattgggaaactttgtggctggaaaatacaaatgtcttctatgtcagaaagaatttgtgtcagagagtggtgtcaagtatcacatcaactccgtccatgctgaggactggttcgttgtaaacccaacaacaaccaaaagctttgaaaagctgatgaagataaagcagcggcagcaagaagaagaaaagcggaggcagcagcacaggagcagaaggtctctaagaaggcggcagcagcctggcattgagcttcccgagacagagctgagtcttagagtagggaaggatcagaggaggaataatgaggaactggtagtgtcagcctcctgtaaggaaccagagcaggagccagtgccagcacagttccagaaagtaaagcccccaaagactaatcataaacgaggaaggaaataggcagtcagtgtaaaagtgctcctaggaaagcagatgtgatgctgttgtcacggggacctgtgctgggaggactgagtgaagattctttcagctgtttgtgtaaggctgtgactttctcagctccttcctcctgtgtaaatttcactgtcttcccttcttacattttgattcccccctccccttttagtaggttttcctgctattcctcgtcaagtcctcttgtttttttatcttgcccaaagagctccctctcaaggccaactataggctcctcttgccctgtacaaaactaagaaacctctttggttgtcctttccttcctggggtatagaatgttcttggaagctccattgatttagtagctgctccatcatctagcttgtgaaaccattccaaactaattttttaaaaccataactgatttgtcattttgtatttgtgatataacaagtctagaagttagaactgttgtcattcacataataagattactctgtctccttgggaaaaaaactttatggaggctgtttgtcctctcaatatggttttaagattgaaagtaagaaaacggatttaggatgaaaactctagaactaccctatgctgtttatactgggaaatgctttgtaccaagtagcagtgactagacccacagacatgaaaagcaaccttaggagtaaagtgacccaaacattaaaatgacaggaaagagaaagtagaagcagcaataaatactgccccaactttcctggagcccgaggcctcatccatagctatgatcacttgccctctgaagcttatttttgcttctttggttttaagaattgagaaatatcacattgcccctgatgttttgacagtctcctagtgctcctggtagtgccactaagggaaaaccaaggtgcgcattccttctccctggactttaccttacttgttagtctacgccccactgtttccacccatccccttagccaacctctgtctttttgaattttctgagaatattgtcctatcctcttttatatatggagttctctcctctttatatcctgagactttgacaccagatgtagatatttatctggagctggaaagaaaaattctttttctgt

SEQ ID NO: 1269 - DNA, 2498 bp, Homo sapiens
gttgccagaagccaggatcatagagacgctcggcctccgccgcacgcgctggcggactaagagtggctggcgaagcgagcggccggcgcgggcccctggcgggcgggcggtacagccccaagcctgagacccggacctgagcatcgcaggttcgagtcccgccccgcctggggcgaagccgggggtggcggcgacctcgcggcgttgcaccggctctgtgagcacctcccctctgagcacttcccttgtgacaggccacttcccttgtgacaggcccaggacgaggtggccaggcggcccccatggcgtccctggtctaggcggagaaccgcctgggcgatgagtgagaacctcgacaacgagggcccgaagcccatggagagctgtggccaggagagcagcagtgccctgagctgccctaccgtctcggtgccccctgcagccccggcagccctggaggaggtggagaaagagggcgctggggcggctacagggccggggcctcagcccgggctctacagctacatcagggatgacttgtttacctctgagatctttaaactggagctgcagaacgtgcctcgccacgccagcttcagcgacgtccggcgcttcctgggccgctttggtctgcagccccacaaaaccaaactctttgggcaaccaccctgcgcctttgtgacattccgcagcgctgcagagagggacaaggccctgcgcgttttgcatggtgccctctggaaaggccgcccactcagtgtgcgcctggcccggcccaaggccgaccccatggccaggaggaggcgacaggagggtgagagtgagccaccagtaacacgagtggccgacgtggtgacccctctatggacagtgccctatgctgagcagcttgagcggaagcagctggagtgcgagcaggtgctgcagaaacttgccaaggaaatcgggagcaccaaccgtgccttgctgccctggctgctcgagcagaggcacaagcacaacaaggcctgctgcccgctggagggggtcaggccatcaccccagcagactgagtatcgtaataagtgtgagtttctggttggcgtcggggtggatggggaggataacaccgtgggctgtcggctcggcaagtacaagggcgggacgtgtgctgtggcagccccgtttgacaccgtgcacatccccgaagccaccaagcaggtggtgaaggccttccaggagttcatccggtccactccatactcggcatacgacccagagacgtacacaggccactggaagcagctgactgtgcgcaccagccgccgccaccaggccatggccattgcctacttccacccccagaagctgagccctgaggagctggcagagctgaagacctccctagcgcagcacttcacagcagggccaggcagggccagtggagtgacctgcctctacttcgtggaggagggacagcgaaagactcctagccaggagggcctgcccctggagcatgtggctggggaccggtgcatccacgaggacctgctagggctgaccttccggatctctccacacgccttcttccaggtgaacacacccgcagccgaggtgctctacacagtcatccaggactgggcccaattggatgcggggagcatggtgctggacgtgtgctgtggcaccggcaccattggcctggccctggcccggaaggtaaagagggtcattggggtcgagctatgcccagaggctgtggaggacgcccgggtgaacgcccaggacaatgagttgagtaatgtggagttccactgcgggagggccgaggacctggtgcccaccctggtgggcagactggcctcccagcacctcgtggccatcctggacccaccccgtgctggcttgcattccaaggtgatcctggccatccggagagctaagaacctcaggcggctgctgtacgtctcatgcaacccccgggcagccatgggcaactttgtggacgccccccttttccccccacagcctctgcagagccccatctaaccgggtgaagggcattcccttccggccggtcaaggctgtggcagtggacctgttcccgcagaccccgcactgtgagatgctcatcctgtttgagagggtggagcaccccaatggcacaggggtcttggggccccacagccctccagctcaacccacaccaggacccccagataacaccctacaagaaactgggaccttcccctcatcctaggcccaggacccattatggggacaggagctgaagggctcccagggccccaggggcggggaaggcatggcttgctggccaggatattcagaggtaggcagccaaagggcacagaaccctgtgccccaccaggattggcctgctgctaggggccaggggccctgaccaggaagacaggtgggttcctgtagcctgttgcccatccccagggcctttgtggactagccaaggctgtgagggccagaataaacaactgctcaac

SEQ ID NO: 1270 - DNA, 2823 bp, Homo sapiens
agctcacttccggaccgcggatagcactggcgaccctagcgggttgagcgcaccatcacatctaagccatcagcaagtttgttggttttaatctccaaaatacgtcttgattttgtctgactctttgccaccaccctgatctaagcccttatcatctgcttgaatcactaacttgtctccacttgcagtttttaaaagagttgcttccatttgactttttctgtctgctgtaccagcatatgagtttcaggaggggtcattgatgcagtcattctcagtctcctcggagggagtctgaagatgcttaaagagcatccagagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtggctgaggcccgagttgcacaccaaggagcagatcctggagctgctggtgctggagcagttcctcactatcctgccccgcgagttctacgcctggatccgggagcatggcccagagagtggcaaggccctggccgccatggtggaggacctgacagaaagagcactggaggccaaggcggtgggttccatgccacaggcagggagagcaggaggaaacagcactttgcagaggcgcttgggagccaggcatccagctggggccagtggaggtcaagcctgaatgggggatgccccctggggaaggagttcaaggtccagacccaggtaccgaggagcagctcagtcaggaccctggagatgagacacgggccttccaggagcaagcactacctgttctgcaggcgggtcctggcctccccgcagtgaatcccagagaccaagagatggcagctgggttctttactgctggatcgcaggggttggggccatttaaagatatggccctggccttccctgaggaggagtggaggcatgtgaccccagcccagatagactgctttggggagtatgtggaaccgcaggactgcagggtctctccaggcggtgggagcaaggaaaaggaggcaaaacccccacaggaagacctgaaaggggcgctggtggcactgacatcagagaggtttggggaagcctctctccagggccctgggctcggaagggtctgtgagcaggagcctggtggccctgcaggcagtgcgcctgggcttcctcctccccagcacggtgctatccccctgcctgacgaagtcaaaacccacagctccttctggaagcctttccagtgccctgagtgtgggaaaggattcagtcggagctccaatctcgtcaggcaccagcgaacccacgaagagaagtcttatggctgtgtggagtgtgggaagggctttaccctgagagaatacctgatgaagcaccagagaacccacctgggaaagaggccctacgtgtgcagcgagtgctggaaaaccttcagccagagacaccacctggaggtgcaccagcgcagccacactggggagaagccctacaagtgcggggactgctggaagagcttcagccgcaggcagcacctgcaggtgcaccggaggacgcacaccggggagaagccctacacctgcgagtgtggcaagagcttcagcaggaatgccaatctggcggtgcaccggcgtgcccacactggcgagaagccatatgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtgagcatagcaggtggcaggcagcaccatcattcatctttctcactgcagggccttgcggggtgcaaggtgatggctgcaggaaagcactggtcccatcgccttcccacccattcgccaacgcgggaaaggcaaggcctggcttacttagagcttccagagagcatagctgcttccatctcttacccaagtggtgctaaacaatttttcttccaatgtttgagggaagcagtctcctgcggttcagttcaggctgagattttctccttcagtggactgtctgtgtccccctgccgaacaaagctgggagtaaaggcaaaaccttgacacgtgttggtagctgggacctcatcttcctgagggctctgtcttgcctgcagggtcatagctcagactcttcccccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtcaggctataacattctatcctcatctgtaaaacttccccgtccattattccttgcactataacaactgtcaacacaccaactattaggaagttagtattttgctattgatcactgaataaacatcagagtattttaaaaaacagttctctagaaagaactgttataattaaaatgagtctgaaagatg

SEQ ID NO: 1271 - DNA, 1168 bp, Homo sapiens
ggaggagccgccgagcggagacccgggagcaggagctgggcctaggtctgcgccctggagggaggtgtagaaagaggtacatggagaacaagtttgtcaatccgtctgaacttcagttgccttacctgtaagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtgccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccg

SEQ ID NO: 1272 - DNA, 2047 bp, Homo sapiens
gaaacgtgttcgctgcccagaagaagggaaggcgcgagtgaggaaaggaggtactgtagctacacttctggaaaattcagtatggacagtctccgacttaggatttttcaactttaggatggtgtgaaagagacacccattcagtagaaactgtacttcgagttttgcattttgatcttttcctggcctagtgataatgtggtacagtacactcttgtgatgctgggcagcggcagcgagccacagctcccagtcacccatgtgatcacgggaatcaacaacccatcctctaccgtgtactgtgttgtcagcttttttggatattgtgttttgtgttttcacattccatcatgtctacaaaatgtccatcagtgtctcctgtttctggtgagatgaagaagaggaaggcaattactcttgaaatgaaactcaagataattgcccagcatgaaggtggcaagccagtaatggccattgcacgtgagttaggactttggcaatccacgatttcaaccatcttaagggataagaagcaaatcagtgatgcagcgaaatcgtcagcatcagttaaatccactgtcatcacaaagaaaagggctggaccaattgatgatatggaaaaattacttgttatgtggatggaagaccagatacagaagcgtataccacttagcctactgatgatccaggctaaggcaagaagtctttttaatatgctaaaagaccgtgccagtgatcctacatatacacaaatgtttaaagcaagtcatggatggttccagcgcttcaaaaggcgtcataattttcacaatgtaaagatcactggtgaggcagcacgtgctggtaatgaaggtgccatagcttttaaggaacagctgcataggataattatggctaaagatctttgcaataaggagctgattgcactggaggaagaaagaggtaaaggcgttgaggcagtggaagaagttacacccacggcacctagaaagttcacagcaaagaaactggccgaggcatttgctgctatcagcagtggcctacacgttagaagaaatggacgtcaattacgagagattcgccacagttgacaggcagatacaggatgctcttgcttgctacagagaaatatgtagtgaaaagaagaaacaagctgtacggtcaaaacttggtatcttcctgaagaacaacactatgcttgctaaaccatcaactagtgttgatgtcccaatgccttctaccacctattctcgatgttcatcagaagagagagaaattgaggaccctgttgcatccccatcatccagcaattaattctatttcagtgcttcaaacatttttcaggaccactgtgctttcagctgtgtaaattaatgatgccctccaaatccttggttatggaatatttggctcatcccagtacactcggcttggctgttggagttgcttgtggcatgtgcctgggctggagccttcgagtatgctttgggatgctccccaaaagcaagacgagcaagacacacacagatactgaaagtgaagcaagcatcttgggagacagcggggagtacaagatgattcttgtggttcgaaatgacttaaagatgggaaaagggaaagtggctgcccagtgctctcatgctgctgtttcagcctacaagcagattcaaagaagaaatcctgaaacgctcaaacaatgggaatactgtggccagcccaaggtggtggtcaaagctcctgatgaagaaaccctgattgcattattggcccatgcaaaaatgctgggactgactgtaagtttaattcaagatgctggacgtactcagattgcaccaggctctcaaactgtcctagggattgggccaggaccagcagacctaattgacaaagtcactggtcacctaaaactttactaggtggactttgatatgacaacaacccctccatcacaagtgtttgaagcctgtcagattctaacaacaaaagctgaatttcttcacccaacttaaatgttcttgagatgaaaataaaacctattcccatgttc

SEQ ID NO: 1273 - DNA, 2269 bp, Homo sapiens
aacaaaagtgctgcagccgcttgctccggccggcaccctaggccggcccgccgccagctgtcgccgacatggaacccttggccagcaacatccaggtcctgctgcaggcggccgagttcctggagcgccgtgagagagaggccgagcatggttatgcgtccctgtgcccgcatcgcagtccaggccccatccacaggaggaagaagcgacccccccaggctcctggcgcgcaggacagcgggcggtcagtgcacaatgaactggagaagcgcaggagggcccagttgaagcggtgcctggagcggctgaagcagcagatgcccctgggggccgactgtgcccggtacaccacgctgagcctgctgcgccgtgccaggatgcacatccagaagctggaggatcaggagcagcgggcccgacagctcaaggagaggctgcgcagcaagcagcagagcctgcagcggcagctggagcagctccgggggctggcaggggcggccgagcgggagcggctgcgggcggacagtctggactcctcaggcctctcctctgagcgctcagactcagaccaagtcttgcctaatgaaaacgggggaactcccaaccacagacccactggaagaggaaataatatcagttcccatcactgacactgttggccgtgccaggcagtgcacttaattctcacaacttgaggctgttctgtctccacttcacggatggtagaaatgaggctgagtgacgtgactcgcctgaggtccaaaaacagtgaagccaagattcaaaccagagccttccgactccagagctggggccaactgaattcaacaagtatttattgagtgtctattatgtgctagatactgagacacatcagagaacaaaaccaaaagccctgcccttgtcgggcttacagtctagcacttaccgccagttaacctgcaggctacctggagccccgggcaagtcaccgcacctctgtgcctcggtcctcagctgcccaatgggagaataagcagacctggctcagacatgaatcatgtgcttggtgtactgcagatgccaaactgcatccccacaacccaccacgtagacagcagacagggctggaagttgatttttaatgataaagtacaatgaagggagggcagaggggctaagcctagctgtctggggtgctgtggtggtggtagactggctacacaaactgttgctgctgctgctgcttcttggtggccgccttgctggcgaggtccttggccttctctgtagctgccagtgccgtctcctttgccttctccttggcttccttggctgtctcaacaagtgttttggaaggggcctcgcctgtcgcgaacggcaggtggctgcctttagaagatgcctgaaagaccaacctaatttccctcccccatgacaccaatctcctctgggccaggctccactaaaaaggtggtattcaccctcctcccacccccagtacagacaaggagtcccagctcagagcagggcaatgactaacccagactccacgcccgctaggctgaatgagcctctccctatgaggaatatccacatacccagaaactcaccttgcagcttagccaagatatattcaaaacccttcatagtcttggtcacgttgcttttgaaccgggcaagaccaaattcctggcatgagatgagaatgggaaggatactgagttgcccactgaccccagcccggccccaacaccgaaagcactgggtcccagagccccagcagccccaacaacactgctcacctggacagctctggagacaccaaataagctagaggagacccaggcttcccggcggatttcagtccagccactgttgtcagagttcacacagtaaacacatcgttcctccaccacctatgcagaggccaaccacaatcgtggaacagtctttcattttgccaacttgcacataaatctgactccctgtcacttttcatgaggcgaagcaatacaatgaaaatccattccttcccctgactgcacctccaagtggcactgacagaacaagaagccataaataaggtcgttttgctctcgaaaacctctcttctgactcttaaactagaaggcaaaaggtctctctcttgagatcaacaaagggccttccagcccatcctgctcctggattttgttttgtgcatctagacgcatgcagtgttttagccgccttccaccagctgcagctctggagcttcctgacagtccaaataaaaacatttgcccgg

SEQ ID NO: 1274 - DNA, 2411 bp, Homo sapiens
tttgcctgggactgtgcttgttttcctagagacttccctttaactgctggatgctgcctgggtgcaagtcctgggagccctgtttgctgctgggcccagggctgatcatcgtggcccattctcacacccttgagatttgggcccaaagctgactaggggcactcagttaaattgttacatagggcacagtagagaggccatggaatagcagtttgctgtagatttggggagttctgggtagggtggcagcccacagctccttgaggctgaggaggagacagtgcagacccagaagacgctgacgcaccgccccctcgcccgcccaattcaatgactggagttcacgtggccctgaagcctctatgcacccgggctgttgggtgcaggaagcactggtgttgaatcatgaaggtgatatgggcttctctgagcctggatcccacatttgcagggctctgggaggcttgtcacctaaatgcacatgctcagggcccttaagaaggccagggttgccctctgctggcagatcatggtttagctcaggagtgcggcttcccccctcttccccaggatcagggcccttctcttccccaggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccccagcctggcctcccccctgagcagcaggccctgctaggaagtggcggaagccgtaccaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtccgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggggaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccgtcctgtttctcttatttattgaaactcaccattgccctatccttgtgtctccacccccttccatgtgttgaataataaaaggtgggaaagtgc

SEQ ID NO: 1275 - DNA, 2641 bp, Homo sapiens
gaaaactttgggcttggcattaggagagcctcggctgaaatccgaggttttgaacgcgattttttccgacagaagctgggcgctttctttcatgtaatgctgcagctgagcctgggacaggtctttgaaagctactccagaagggtatttctccaccgccgggaccaccagtttattcctttcggctaaatacgtttttggctgcgggtgcaaaggggaactgaggaagtaggaggccaccgggtggatgttcacgccggctgccgggtggcatgggccgtcacctcggttcaggtagcacaaggcgcccatggcgtggaatgaagagtggttgaccacacgcggccttaccagcttgtactgctgcagcggcagcgcgtcgcgggccaggtcgcccttgagactcagtgcgcagttgagcaggtcgctgcagctgaatgcgggagccgagggcaccgccgcgggcgccgccggggcctccagactggccttccgcggctcggagcccgtcactcctgccttggggctcgtgtcgtaggccacaggcacgaaggggatcatgcaggggatcgacgagttgagatgcagagagtgcttgggttcccccttggcatcaccagccgaacctgcctgcccagcccaatggactcctgccagcccatcgcagagttcttggcgcaccaatgactcggggacaatcactacttatttctatcaatagaaagtgttgtgtcaataacgcagccaagatctcgccaatcgttaacttccaagaggagaagggctcggggttgcccgctcccggaatcccggagtctccgcggcccgaaccgagtctggaccatttagaagacgccggcaggtaactggcctccccaaacgccccgaaaattaaaagccttaggaggcttgttctgtgtttgtggttttgtaaaggcaatgcccgcggcaataggcctgggaaagtcacactttcatccacaaagttgaggagttgcaaggaataattgggtgtcacaccacaagcaaccttgactcgatcggaccccacccaggatacacacagacgcgcgcgcgcgcacgcttccgagtttccattgagagtctggaaagagcatttctttcttaagtacctgcgctcagctagagctcttccggagcattttaaatactgaatgccgagcggagaagggaaacagagtgtattaatccccactccggttgccggtgtctgcaagcctcctctaagcagcgcaggcggcagcctggatgtctgtgcgcatcaaggagacttgccggcgccagagttgtgtccacaggtgcacttgtgcctcccaaagagcgcgcgtagagaccatttcccctgcaacgccccccagccgaacacccgccgggtgtggcacctcggccgaaactcctggggcggcgcggtggagcgtgtggaggtttccgggaagacgcctacggctgcggctccgactgtgcgggctcccgccgcccaggcaagagcgtccaggagcgcgctggaagctgcggcgcgcaccttccccggcgcagtctcttgccagccggcgatcacgcagagctgaaccccgcagctaggcgcgcaggaagtttgaagacacggcagctgtaagctggcgtgaggaggccaaaggagcgcgcagagctgcaagcaaagggcggtggggcctggaccctgaagtgagtggccgaccgcagcagctcaaggtgccatctgcctggcaagctacccgggtccctccgccccactctaactttccgcgaaaatcagttccgcctctgccccaagagccaagaggggtggaaaggaagagagcttgggctgggaacgcgcctgatgtctaacagaaaggcagtggcagctgtcgaaaaatccccctcctgctgcactcctccgccaccgggctaggttgaaaggaaaaagccaagaagcgcgaagcagcccggctctggaaggctttggagagtccagctgacttgtacacaattcgcggcctctggagccttacctgccttcttgactgaatgccaccagttcgttttacgcttgtggctttttgttgaagtccctatcataagcaaatgcagtttctggctatggttactgcaattcgaaataaaaggcctgtgaggtgtgtccctccagactgagaggctatgactcagggttggactttatggaaaaaaagaagtttataaaacaagtaacccagtttctccaacctttactgtggagcaacagcgtcaagcaacaaaacccagcaaagttttgcttgtcacttacaagggtgttactgaaatctggaaggcgaacaattagaagatagcccaaacatgctctattgctctacactgaaatacttgcctccaataatagaaaaaacctgttttcgtgcaattgattgattagcgttctgcagcagtccctggacaattttaaagacattttgtgtttgtggccaaaattagaaacaagcagacacacacacaaaacaaccatattcaagacacggttcgactgtttccttgacactacccacgaagtttaaagcattttttatgttattttcaaactttcttaagtgatcccatgaaataaaagtcgataatagaaatt

SEQ ID NO: 1276 - DNA, 2526 bp, Homo sapiens
tttcgagcatccctagccgggcaggtgggaggcacggggttgcggatcccgcggccgcggttcggacccgccggcgacatggccagctccggagaggacatatccaatgatgatgatgacatgcaccctgcagcagccgggatggcagacggggtccacctcctagggttctctgatgagatcctccttcacatcctgagtcacgtccccagcacagatctgattctgaacgtccggcgtacctgtcggaagcttgcagccctgtgccttgacaagagcctcatccacaccgtgttgctgcaaaaggactatcaggcgagtgaggacaaagtgaggcagctggtgaaggagatcggccgggagatccagcagctgagcatggctggctgctactggctgcctggctccaccgtggaacacgtggcccgctgccgcagcctggtgaaggtgaacctctcgggctgccacctcacttccctgcgcctctccaagatgctctcggccctgcagcacctgcgctcgctggccatcgacgtgagccccggcttcgacgccagccagctgagcagcgagtgcaaggccaccctgagccgcgtgcgggagctcaagcagacgctgttcactccctcctacggcgtggtgccctgctgcaccagcctagagaagctgctgctctacttcgagattctggaccgcacgcgcgagggcgccatcctctcgggccagcttatggtgggccagagcaacgtgccgcactaccagaacctgcgggtcttctatgcgcgcctggcccccggctacatcaaccaggaggtggtgcggctctacctggctgtgcttagcgaccgcactcctcagaacctccacgccttcctcatctccgtccctggcagcttcgcggagagcggcgccaccaagaacctcctggactccatggcgcgcaatgtcgtgctggatgccctgcagctgcccaagtcctggctgaacggctcttccctcctgcagcacatgaaattcaacaacccgttctacttcagtttcagccgctgtaccctgtcaggcggccatctgatccagcaggtcatcaacggcgggaaggacctgcggagcctggccagcttgaacctcagcggctgcgtccactgcctgtccccagactcgctgctccgcaaggcggaggacgacatcgacagcagcatcctggagacgctggtggcgtcctgctgcaacctgcgccacctgaacctctcggccgcccaccaccacagctcggagggcctgggccgccacctctgccagctcctggcccggctgcgtcacctgcgctccctctccctgcctgtctgctctgtcgctgactccgcgccgcgcgccgaccgcgcgcccgcccagccggccatgcacgcagtgccgcgcggctttggcaagaaagtgcgtgtgggcgtgcagtcctgtcccagccccttctcgggccaggcgtgcccccagccctcctccgtgttctggtctctgctgaagaacctgcccttcctggaacacctcgagctgattgggtccaacttctcctccgccatgccccgcaacgagcccgccatccgcaactcgctcccaccctgcagccgcgcacagagtgtcggggactcggaggtggccgccatcggccagctggccttcctgcggcacctgacgctcgcacagctgcccagcgtccttacgggctccgggctggtcaatatcggcctgcagtgccagcagttgcggtccctgtcgctggccaacctgggcatgatggggaaggtggtgtacatgcccgcgctctcagacatgttgaagcactgcaagcggctgagggacctcaggctggagcagccctacttcagcgccaacgcccagttcttccaggcgctgagccagtgcccctcgctgcagcgcctgtgcctggtctctcgcagcggcaccctccagcccgatgccgtgctggcctttatggctcgctgcctgcaggttgtcatgtgccacctgttcaccggggagtccctcgccacctgcaagagcctgcagcagtcgcttctccgcagccgctgaggagcccccggcagagctggggttgaagaggcagcttgtcccccgaccttcaggaatggcagcctgcagcaactggaacaaggccccaccgtaaagctctgtgtgtcccagggtcttcctgtcacccaggctggagtacagtggcgtgatcacagctcactgcagccttgacctcccgggctcaagacatcctcctgcctcggcctcctgagtagctgggactgcagttgtaagccaccgtgtccagccagtttctgttgtttgaagcccccaacttctagattgggaaacgaagctctgctgggcgtggtggctcacacctgtgagtggctcccagcactttgagaggccgaggagggaggactgcttgaagccagaagttcaagaccagcctgcacatcacgagacccgccctccccccaccaatctctataaaacatt

SEQ ID NO: 1277 - DNA, 2523 bp, Homo sapiens
aatcgagcgccgagagagcgagtcggtgctactggcgtcgggtcggtccgggtaggcgcagcgggactggacctgggtgccgagcggagccgctgccatgggcctgggcgtcagcgctgagcagcccgcaggcggcgccgagggcttccacctccacggggatgtggaaccatcttcacctgctgcccttgccggcctgcgcccctacacagactatgtggttggttcggaccagattctccaggagccccccagctaccacaagaagccacctggcaccccaccaccttctgctctaccacttggtgccccaccacctgatgctctaccacctggacccacccccgaggactctccttccctggagacaggttccaggcagagtgactacatggaggccctgctgcaggcacctggctcctccatggaggatccccttcctgggcctgggagtcccagccacagtgctccagaccctgatggacttccccatttcatggagactcctcttcagcccccacctccagtgcagcgagttatggacccaggcttcctggacgtgtcgggaatttctctcttggacaacagcaatgccagtgtgtggcccagcctgccctcttccacagaactgaccaccacagctgtctcaacctcagggccagaggacatctgctccagcagcagttctcatgagcggggtggtgaggctacatggtctgggtcagagtttgaggtctccttcctggacagcccaggtgcccaagcccaggcggaccacctgcctcagctgactcttcctgacagtctcacctctgcagcctcaccagaagatgggctgtccgccgagctgcttgaagctcaggctgaggaggaaccagcaagcacagagggcctagatactgggacggaggctgaggggctggacagccaggcccagatctctaccacagaataacaccctgggctgtgacaaggcccatgatgacatttcatgaggcccagatgtgggcaggcagcccgggctgcactatgcggtcaggattccttgctgctttggtgggacatgaggcctcagtgggtggtgagagggggccatgggccttgtgggaggatatcttttggccgtgtaccctcaggtccagtgcttggtcctgctctggtcactggggcttcccaggaggcagcagggtctggtcataatccagtgtgaagatgaggtgaggaaggaaggggttgctgtccagtgttggcctggtcgctttgattcttcctgcgcagctcagcccaccccatctgtactggaagggaccctggagccctgggaccaccccctttcaagtcccaaacactgagtcctctgtcatgtgtccttgtccctaggctacaatgctacacttggctcaggctgatcaccatgctagtcacaggagggagagagaggcagtgtacttgcccccatctcctggagggaggtgcgttggaaattctaggcccttcagcagagacccatttgtgcccagaccacaatatttcttcttcctcagggactacatgccacagacctgtatccccagtggcaactcctgttagctcccaaacttaaacagtgatctcttctaaatatacaaggcatctacccagccccaatagtgaataaaagtcacaaatttaagttcaacaccctaagcaatttctcaaagccagtctacctgactaggtctatccacgcacggttcccaaccccaagggggaattaggggattagattaagagtaggtaaagacccttttgttctttcctgttgtaggggaggaagctgttctccccaccccaggtgcctttggaggttaaggctaggttaggccctgcactccacctggggacggcccctcatcacctgaagtcctctgctgtgttgactggaccctcagttcccacactgctaattactatgaaagctgctctggcctcgtcttctagcttgtgcctagttgaaagtctcacctttacaggatcatttgtaatgctggtgtacatgcagggaactcacaagctgtgtcaggtatgcaggacaaggaatgtctgctctggggggcacaggccaactatatggagggagggtcccaaattagcaaacccttcatttaaagcaaacccttgtcaagcctaccagagcagctgatacgtgtgcataacagtgaggcattgtgtcctggatcgtctgggagcccagtgtcaagtctgctggaatgcaggaagtagaacagaatcgccacaggactgttctggggccagcttcccttaactctgtagcttggcagtctgacccaaagttgccctcacccaaaggttctggctcttccctccctcacttttactttcccttcccccataagttggaggataaaatgggtatcaatgctaatatttccagggagaacatgaaaccagaggtttctttctttctctgtaatctgctatgaaagaaaataacaaatgaaaataaatgtgtactacactttg

SEQ ID NO: 1278 - DNA, 2270 bp, Homo sapiens
aggctggtgggggcggtgttgctcggggctgcgatgccccttaggttgcgggcaaccagaggcctcactcgtgggcaggaagcaagggcggaccccgagagatgactgattgtgggggtggggaccgtctgctcctcctaatggctggggaccgtgcacgtctgcgcgggccggacctgctcttctcgggaacttgcgcgggaggaggcccggagctgcgccgctttaccctctgctccccggtgcctaaaacgcacacgcatcaaagtcacaggacgagttagaggagaaaggcagagggagatttgaaacacagaggaggtgatgagaagacacagcagaagatatctgaagactggaaagaatgctgcaaccaacaggagaaggaaaagacagaaatgtgttttccatttggagcatccagagggagcacaaccatatcaacaccttgattttgatccagtgacattgattttggacttgtggcctccagaacttttagagaataaatttgcattgttttaagccaacaggttggtggaaattttttacagcagccacaggaagcaaacacagactcctaactggtgcttagtcctagaatatcagtttctgttccacttctggatctcataattgcatctcagacatcaacactgacttcatattcttaatgcaccaattctaccatttcttcaggctgcaaacagagaaaaacttatttaagcattccagaattgacccaatagaagactctccagaaaagactgcatggtctctgaagcagcatgatcagcatgactggctgcatctgggctccaccgtttgccacttcagacaggtccttagcctcttagaggttcattttccttgctgtagcccggagtaagaatgtttagcctacaagatttattttgaggcatcaatgaatcactatgtgagcctcacacagtgtctggcactgatattacaaaatatggttgatcttgccatccttgttattgtcctggtggggattcctctctgttgaagatacggagcctctaaaaatgagtggcagaggctcccagctcaggatccttgtccaggtcctaaagatcctccactctgcttgtcactctgttcattatgtttgcatggccaccacggtcaacactactgcggcctacctcaagtcctcatgcctcactctctgagctcatgaggacacaaggatcctttggcaacacattaactacactctgtggccatcccttgacttctgagaggatgtttccctcctctcaatcaaaagctctcttccctcctgggcaagatccttgcatgcacccagcaccctcacacctggtgccctcacacccagcactctcacacgtggtgccctcacacccagcaccctcacacccagcaccctcacacctggtgccctcacacccagcaccctcacacctggtgccctcacacccagcaccctcacacctggtgccctcgcacccagcaccctcacacctggtgccctcgcacccagcaccctcacacctggtgccctcgcaaccagcaccttcagaggaagaaataacagaggctgcaggcgagagagttacaaggaaggaggagcaggaagacacgagaaaaattcagataaactcaacatctccagcctgggggaaacgtgagagggtggtatgaagatacacacgatgcatgttgcttagtgaaagcagccagtcggaaaaggctacgtagtgaatgaccccaactatgacattctgaaaaaggcaaaactatggagacaggataaagatcagtggttgccagtgaggcaggagaatagggtctgggggcagggagcctaaggctgattcatgctgacttcatgaacggaatcaaaaggaaaaccctaaatttccatgcccacgtaacaaaaggatcagaggctactccctttgcaactccccccaactttctgtgttgcagatgaaaaatggaaagtgcctcggattggtcccctcctgcaaccagtcagacatctgcatagagcgtaactttgtaacttcacttcagcctctgcttggtcaccttccacaaccaatcagactggtcatgggccactatttcatagggtgtaaaccaagtgaccaatgggaaacatctagagggtatttaaaccccagaaaattctgcgaccagtgcttttgagccttgcttgggcctgctcccactctgtgaagtgcatttttgtttcaatacagctatgcttttgttgcttc

SEQ ID NO: 1279 - DNA, 2152 bp, Homo sapiens
aattgaagtagtcacttctttcagaatgctaagttccctggaatattttcccagcctactgtgtctatgatagactcaaatattggaagttttaccggctgtgtgtggggtggggaaggaattctgttggttctccggtgagtcctgaagagaccttgtttctggagccaggaagaggagcatagaaagaaaaaggaacaggaaattgttcaaaagaagttcatgaaatgagaaaagcagcaggaaacagctcgggaatcggcgaggctgcagccgaaggaagacatcttccttttaagcagtgactcgggaatcgaggccacttccatcctgtaacgacgccatctggagcatgtggcttccaggggagcagtggctgaggccctgcagtggcttctcactgctacagtccagagttgcacacagcacttctgctcatagtccatcagccaggagctagtcatgtggccacctcgctgcaaggatccaggaaggcagagtgcggagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccctgccttgcccctggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacgaggacatgcaggagaactgtcgggaccaggaagactcattccaaaaaggagcccaggccgggcacagtcgtcaagcctgtaatcccaacactttgggagaccgaggtcgggggatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctc

SEQ ID NO: 1280 - DNA, 3352 bp, Homo sapiens
agtgccgggccagacatggcggaagaggaggtggccaagttggagaagcacttgatgcttctgcggcaggagtatgtcaagctgcagaagaagctggcggagacagagaagcgctgcgctctcttggctgcgcaggcaaacaaggagagcagcagcgagtccttcatcagccgtctgctggccatcgtggcagacctctacgagcaggagcagtacagatgctaatcctgaggtgacgatgacaatgcttcgctggatctatacagatgagctggagttcagagaggatgatgtgttcctgactgaactgatgaaactagcaaatcggtttcagctacagctcctcagggagagatgtgagaagggtgttatgtctctagtgaatgtcaggaactgtattcgcttctaccagacggcagaggagctgaatgccagcacactgatgaactactgtgcagaaattattgcaagtcattgggacgacctgaggaaggaggatttcagcagcatgagcgctcagttgttatacaaaatgatcaaatccaagacagagtacccgctacataaagccatcaaagtggagagagaagacgtggtcttcctgtatctgattgaaatggattcccagctccctgggaagctgaatgaagcggatcataacggagatctggcattagatctagccctctcacgacgactggagagtattgccaccacgctggttagtcacaaagctgatgtggacatggtggacaagagtggctggagcttgttacacaaaggaatccaaagaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggactcctttacatgtgtccatcatggccgggaatgaatatgtgttcagtcagctgctgcagtgcaaacaactagatttagaactcaaagaccacgagggcagcacggctctgtggctggcagtgcagcatatcacagtgtcttctgaccagtctgtgaaccccttcgaagatgtccccgtggtaaatgggacttcatttgatgagaacagctttgcagccagactcatccagcgcggcagccacacagacgcacctgacacggcgacaggaaactgtttactacagcgggcagctggagcaggaaacgaggcagcagctcttttcctggcaaccaacggtgcccatgtcaaccacagaaacaagtggggagaaaccccgttgcacacagcgtgtcggcatggcctggccaacctcacagcagagctcctgcagcaaggcgccaacccaaacctgcagacggaggaagctctgcctctgccaaaggaggccgcatccctgaccagcttggcggacagcgtccatctgcagacgccactgcacatggcgatcgcctataaccatccggatgtggtgtctgtcatcctggagcagaaagccaatgctcttcatgccaccaacaacttgcagatcattccggacttcagcctcaaagattcccgagaccagactgtgctgggcctggcattatggactggcatgcacacgatcgcagcccagctgctgggctctggagccgccatcaatgacaccatgtcggatgggcagacgctactgcacatggccatacagcggcaggacagcaagagcgcactcttcctgctggagcaccaggcagatataaatgtcagcaggactcaggacggggagacagccctccagctggccatcagaaaccagcttccactcgtagttgatgccatatgcacccgaggagctgacatgtctgtgccagatgagaaggggaaccccccgctgtggcttgcattggcaaacaatctggaggacatcgcatccactctggtcagacatggctgtgatgccacatgctggggtccgggacctggtgggtgccttcagacgctcctgcacagagccattgatgaaaacaacgagcccaccgcctgctttcttattcgcagtggctgtgacgtgaacagtcccagacaaccaggcgccaatggagaaggagaggaagaggctagagatgggcagacccctttgcatttggcagcctcttgggggctggaagagacagtacagtgtcttctggagtttggtgccaacgtgaacgcacaggatgcagaaggaagaacccccatccacgtggccatcagcagccaacacggtgtcatcattcagctgttggtttctcaccccgatatccatttgaatgtacgagacagacaagggctgaccccgtttgcctgtgccatgactttcaagaacaacaagtcagccgaggccattctcaaacgagagtccggggctgctgagcaggtggataacaagggccggaatttccttcatgtggcagttcagaactctgatattgaaagtgtgctgttcctgatcagtgtccacgctaatgtgaattcaagagtccaggatgcctccaagttgacccccctgcacctcgctgtccaagcaggctcagaaattattgtccgcaatttgcttcttgcgggagccaaagtgaacgaattaaccaagcatcgccagactgccctccatcttgctgcccagcaggacctgcccaccatctgctcagtcctcctagagaatggcgtggactttgctgccgtggatgagaatggaaacaatgctcttcatcttgctgtcatgcacggccggctcaacaacatccgggttctcctgacagagtgcacagtggacgccgaagcctttaatctcagaggccagtcaccactgcacattttgggacaatatggcaaggagaatgcagcggccatctttgatctcttcctagaatgcatgccggggtatcctctggacaagccggatgcagacggcagcacggtgctgctcctggcatacatgaaagggaacgccaacttgtgccgcgccatcgtccggtcgggggctcgcctcggggtgaataacaaccagggagtcaacatcttcaactaccaggtcgccaccaagcagctcctgttccgactgctggatatgctgtccaaggagcctccgtggtgtgacggctcctactgctatgagtgcactgccaggttcggagtcaccactcgcaaacaccactgtcgtcactgcggacgtcttctttgccataaatgctcgaccaaggagattcctattataaagtttgatctgaacaag

SEQ ID NO: 1281 - DNA, 1971 bp, Homo sapiens
gtggacatttttgttggatgaaggattttctgttaaatgtgtctggcacacacagaaaaacaaagcccagcaggtacgatggtgattattattgttactggtggcgctctattattgttattagtgtctgttgaaaaagaccctgagctataccagcccttggttctccagcctgtgaaatgggcatcctgggcactgaggcactagccttgggaagctgatagggggtccctgcaggagagacaaagaacactgcccacccccccgggggagcctgcgcccctcaccggaaagagaagcaggggggagcagagggagcttgcagccccacacgcagggctgccagaaggccatacataattcattgccaaatggggctgcgggcggctctccgcggcgtgcgctgggggctcactctgcgcctggcacttcgctgactgcgcctcacacgttgcctcattgcatcttcatggatttgcagggtgtgacccttccccctgttttacccagggggatcctgaggctcagaggatggggccaccgtgctagtcacacagcctctctgtggccaagctgggcctcgggccagcagattcggcccccagcggcccccattcactgcctctctgctgagggaaaagacgggcctggggagcgggtgggaggcacaaaggagaccccgctctgagacaggctgcagaagagggagctgggtctcagcagggctggggaaggctctggccccagccctccgcccaaccccctgccctcctctcctggaggagatgctccccaaattagccatcatgagcgctggctctgggggttgggcgttggggagcagtttgctcagctgtaaaatgggaataacagaagccgtccctgggactatgagatcaaggtgctcaagaaaagtggtgtctgctgaggggaaaagccagtcccaaaaggttgcatactctcattctgtttatttgtttttgtttttgagacagggtctcgccctgtcacccaggctggagtacagtggcgcaatatgggctcactgcaacctccacctcctgggctcaagtgatcctcccatctcagaccctcaaggagctggggctacaggcacgtgccaccgtgtccggctaatttttgtattttttgtagagacagggtttcaccatgttgcccaggctggtctcaaactcccgagctcaggtgatccgcctgccttggcctgcgataaaattgcacagaagtaaatacacacacgtgaggatacggaaaaccggggaaacctgagcaagagcagtcagaccccggctgtgatggcgcccagtagttctgcgagatgttaccattggggaaactgagtgaaggcgggtacctgggatccctctgttttcttttttgttgttgttgttattttgagatgaagtttccctcttgttgcccaggctgggtgatccacctgcctcggcctcccaaagtgctgggattacacgcgtgagccactgtgcccagcctctctgttttatttcttctttttttttttttttttggagacgctctgtcgcccaggctggagtgcagtggcacgatattggctcactgcaagctccgcctcctgggttcacaccattctcctgcctcagcctcccgagtagctgggactacaggcgcccgccacctcgcccgtctaattttttgtatttttagtagaggcggggcttcaccgtgttggccaggatggtctcgatctcctgacctcgtcatccgcccgtctcggcctcccatagtgctgggattacaggcatgagccaccacgcccggctgttttatttcttataactgtacaggaatctacaatgattgtaacaaaaatttcaattaaggccactctaggcacatggcctgtggggtagccctgctcaacaagaagccgtcaaaaaaatgttttttaattaaaaaatttcttcaatt

SEQ ID NO: 1282 - DNA, 1806 bp, Homo sapiens
gtgggggtctgtggctgctgggctggcggggcgcaggccgcgggacccgagcccggggaagcgagagagcggaggcgccgaggatccgattcactccctggggagacctatgggccgaagccgtgtaaatgcgttttaaggcgagtgcggaaagtggcctggggagcctcggggagcggacgccctccgccctggtgctgacctgcctccctgccccttctgcctcctgtcagcagaggcctcggctccgcaactgccactcctcctcggggtgttgcacaagtttcgaggtcaccggcgaccccccctagcagcgcgcctggctctggcccccgcgaaggaggacggagtttggcagagatggagttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcgaagaagcaccatgtggaggtggtgggtgtgagttttcacattggcagtggctgtcctgaccctcaggcctatgctcagtccatcgcagacgcccggctcgtgtttgaaatgggcaccgagctgggtcacaagatgcacgttctggaccttggtggtggcttccctggcacagaaggggccaaagtgagatttgaagagattgcttccgtgatcaactcagccttggacctgtacttcccagagggctgtggcgtggacatctttgctgagctggggcgctactacgtgacctcggccttcactgtggcagtcagcatcattgccaagaaggaggttctgctagaccagcctggcagggaggaggaaaatggttccacctccaagaccatcgtgtaccaccttgatgagggcgtgtatgggatcttcaactcagtcctgtttgacaacatctgccctacccccatcctgcagaagaaaccatccacggagcagcccctgtacagcagcagcctgtggggcccggcggttgatggctgtgattgcgtggctgagggcctgtggctgccgcaactacacgtaggggactggctggtctttgacaacatgggcgcctacactgtgggcatgggttcccccttttgggggacccaggcctgccacatcacctatgccatgtcccgggtggcctgggaagcgctgcgaaggcagctgatggctgcagaacaggaggatgacgtggagggtgtgtgcaagcctctgtcctgcggctgggagatcacagacaccctgtgcgtgggccctgtcttcaccccagcgagcatcatgtgagtgggcctcgttccccccggagaatcccagcggggcctcagagatgcatctgggagaggtggggaagatggcaggcaagggtacccttggccaggactctggtgcccaccctgccacccccgcgctccacctgcagtgtttctgccctgtaaataggaccagtcttacactcgctgtagttcaagtatgcaacataaatcctgttccttccagctgtgtctgcctcctctgcagtgcaaggggcctggtcagccaggtgtgggggtgctcttggggtctcctttggtctccttcccacctttgtaaatataatgcaaataaataaatatttaggtttttaaaaactgc

SEQ ID NO: 1283 - DNA, 1977 bp, Homo sapiens
ttaggtgctcaggttcagggcttcgacggggatggttttggaactcgggagccctgagcgtccccctcctctgtcccctaggacatcctgaaccacgtgttcgacgacgtagagagctttgtatcgaggctgcagaagtcggcggaggcggccagggtgctggagcaccgggaacgcggccgcaggagccggcgccgggcggctggggagggcttgctgacgctgcgggccaagccgccctcggaggccgagtacaccgacgtgctgcagaagatcaagtacgccttcagcctgctggtgaggacgcgcccgcccctgggccggggcgcgggcacgacgaacctgtcccgtccccgcacccacgccaaccacctccctccccacgccccaggcccggctgcgcggcaacatcgccgacccctcctctccggagctgttgcacttccttttcgggcctctgcagatgattgtgaacacgtcgggggggccggagttcgcgagcagtgtgcggcggccgcatctgacatcggatgccgtggcgctgctgcgggacaacgtcactccacgtgaaaacgagctctggacctcgctgggggactcgtggacccgccccgggctggagctgtccccggaggagggacccccatacagacccgagttcttcagcggctgggagccgccggtcactgacccgcagagccgcgcctgggaggacccagttgagaaacagctacagcacgagcggaggcgccggcaggtgacccaagcgacacagcagggccgaggctgggaagtccgggggcgcggccggtccgcctggccccgcctgacccgactgtcttacttcctacagcaaagcgccccccaggtcgctgtcaatggtcaccgagacttggagccagaatctgagcctcagctggagtcagagacagcaggaaaatgggtcctgtgtaattatgacttccaggcccgcaacagcagtgagctgtcggtcaagcagcgggacgtactggaggtcctggatgacagtcgtaagtggtggaaggttcgggacccagcggggcaggagggatatgtgccctacaacatcctgacaccctaccccggaccccggctgcaccacagccaaagccctgcccgcagcctgaacagcactcctcctccaccaccagccccagccccggccccacctccagctctggctcggccccgctgggacaggccccgctgggacagctgcgatagcctcaacggcttggaccccagcgagaaggagaaattctcccagatgctcatcgtcaacgaggaactgcaggcgcgcctggcccagggccgctcgggaccgagccgcgcagtcccagggccccgcgccccggaaccgcagctcagcccgggctcggacgcctccgaggtccgcgcctggctgcaggccaagggctttagctccgggaccgtggacgcgctgggtgtgctgaccggggcgcagcttttctcgctgcagagggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagtccctccggagaggatctggactggctgggagtggggagggcgtggagacagtctacggaaagcgctagcagacccccgagagggtgcagtggagccctgagcattgtaatatgcggcccagcctataaacagcctccgtgcttagc

SEQ ID NO: 1284 - DNA, 2036 bp, Homo sapiens
tgagagggagagcagatgtcaggaggagctacacccacattccggggaggggccgctgctgggtggggggcacgtggggacctgcactcatgcaagcttctgctctgctgcacccaccagccccgtccttgcccgcacccttgcctgcttccctggctggctcccacttgcctcccgtgccaggtgcttctggggctcagcaggagaggaaaggggcagaggggcatagggtccctcgggtacggtgggggcaggcgggcgcacagcgctccggctctgagccaggcctgtgagggaaggggctgcaggctggcagggtgccgacttcccccatggctgctgtgagcccgcagagtcatccttggccccgtcccgcccttggggaagaatgggcccctccgtcctcaggccccttcgacgtgctgagcatccagacgtggcgaggagcccgaagggtgtggggtcccctctgcagggtcctgcttgttgcctgtttccggcgggcggggtgcacaatggggtctctaaggaccgtttcccgccactggccccattgtcactgtctccgccttcctcctcggcctttcagccgcataaagggccagtgaggtttgggacagccacagcccaaggctccgaggctaaaagcccctgggtgggggtgttccaggacacctggccctgtgtgagctgcctcctctcaccccaacccctcggatcctgggaaagagacagccatggctcaagggccagggacccctgggctgagccccagaaatggctttccattctcgcctgggccggggtgggggtggaggccagaggccctgcccaggcagatgaagcccccagctttcaagggggaaactgaggctgtgtgagggacacagctgtgcagggcccacaaacacggtcctttctctaggttagcggatgcagatgcctgatgagtgccatgccctctgtggacacctggggaggggggtcacctccagcgccgccctgggacttccactgcacgtgcaagagacttaccctttcacacagatcacctgcctgccgcagggctgatgaggatgggtgaggagcgcagccactgggtgtcatgcactgtgggggttctcccaccttctgcccctcctcaggttccttgctgcttctctcctctcccaactgtggcacgctgagggctcaggcacaggaccgctcctctggggcagcctccaataacccttggacaacctccactttttcatcttcagccctgaccactccctggggcccatagccttacatccatctgcccccagcccaaacacttctgcaaacactagaaaaggaggtagcccgtgtgccctcctgcaccgcctcctccactcctgtcttggagaggctttcccgtgggccgagcaacccccttacctttggcacttgccctgattctctggccggcttcctacaacctctccttttcagccacacccaagtccacctgttcacaaacaccctgggctgggccctggccgaaccctggcttctacctacctgtctcaggaagtgcctgagccttgcacctacagaccctcccagagaaagccctggctttgcaaccagctgtcttctcatgagacacagggccacaggagcaccacggtgcccaaatgggtcttggagcattagaccaggggcttcatgcctgccctggggacaggtggccaaagtggcatgggagatagggagacagtgtgggtgagcaggtgggcaggagctacaggagcctggggcctgtggatcacagacaccgccaggcaagtgccagttcacacaggtacaggtggctgcagagtgcccaaaggccaagcagcagagtgcctggtgtggacgggagaggagtggggaggttgggcgcagtggctcacgcctgtaatcccaacactttgggaggcccaggcaagcagatcatgaggtcaggagatggagaccatcctggccaacatggtgaaaccgtctctaataaaacacaaaaaattagccag

SEQ ID NO: 1285 - DNA, 1843 bp, Homo sapiens
attctcctctggacctcaccactctcagagctgcttgtcctggcagaatctacagttcaccccaactctatgccttacccctcccaacccaacagcatttgcagtttgcaaaatatacagacccaagtcctgaggggactgaggacatgatgctgggcccaagtctcctgctcagggcttctctccaatgccagccctgccactccttcctcaccctccttggagcctcctctgctgcttgtctatcccaacggccctgctcccctcccttcctgcccttcaccagctttctggacaccatgccctgaggaagggacctttggttttctctaaacatctttgaagggctgaggcagtcagggctggctgccttgtcactctttatttggaagccactcaaaccattcccaagaagagggacctcagctggcaatctggaaacctggcccaggtctgggcagatgtcttcacttctcctaccttcccagtcttgtgatcctgtgatgagcaccaggatggccctgtggtccctagagcacccctcatgctgtagggtcctgcagccccatcctttctctactgggccctggtatcctggctcctctctcagctctgccactgatctctgtgccttagtttacttctctgcacgggggactcaccccaagaccatttccagcagcttcccaggtgatgtggtgccccaaggctgggctttgccagctgtggcccagctccttagtgctgcccaggagacaccaggctgctcagaatgaggtgactgcgggcaccattctcagccagtggttcttgtattgcattccagcagcaggaatatcacctgggaacttgatagaagtgcagattagcagccccacccaagacccactgaattagagcttgtggagtggggccctacaagctggggttttaaggagccctccaaatgattctgacgcataagaatatgccaactgctgatctgggctagccattagtagagcctggggagggactgggactggctaggccaagaacaggtggaaaacaccagccttatctggactcctgagattgggaaccaccaccaacaaaaaccaaccctatagtcgctcctcttggaagaggaagagaagttgaagggcctggagaaagcacacattgtttgtttccctgctcctgctcacctctctcacttgtcttggttttacaaaaggctgtgtggatggtgccagccagggagggggtgggagtcctggggaggcaggaggcagaagaccctgactgtttctcccttgggaacctcaccataggccagatagcgcctcttcaaactgaaagaaatcttaactccacaaagaaagcatcctaaatccccagttcctcctcctcccaaccccagggataccttgtagacagtgccaaaaaacagctccaacccccagcagctgggaagagagccagaagctgcccttcctcctcatcctggcccctccccagcccccgccaatactgtgaacccccttcccactcagcctggtttcctggtgagggtcctgcagtcatgggccctgggggacccccagggcaaggcccatgggagggaagggaccaagggcatccttgggccaactgtccacctctcttgtccactattctctcctttccacttctgtcttcaaaaggctccttcctaggatggatcgggtgctaggacaactgcagtccaatccaccagctctccctgcccctgtgtcttatttcagacatgagaataactgtacagtgtaaacttataaagcgtttttaatggttgtagattggaaataaagtatgtcatatg

SEQ ID NO: 1286 - DNA, 1935 bp, Homo sapiens
gttgtagttcggtcgcgagcgctgccgtcgggaggcgctccgaggttcgaggctgtgccccgcgaccccgccttcggcgctcggctcgcaggatggatcccgtacccgggacagactcggcgccgctggctggcctggcctggtcgtcggcctctgcacccccgccgcgggggttcagcgcgatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccagctttgcacacgccgcttcctctgcctggggcactttttctctcctttttgtagctcattctccgtcctccgtcagatgtcaccttcacccttccctacccctcctcttctgggcccacaaccctagtgcagccctcccagccccacctgaactttcccaccctttcttgtcatttttatttgactcaggctatattcattcatactagagttggcaaacctttttttttttttttttttcttcagacggagtttcactccagcctgggcgacagagtgagactctgtctcaaaaagaaaagaaaagaaaacagaccttgagccagatttggctcatgggtgctagttgtccaacctctataggattagaggactcacggaaagtaagttttgagggccacgatgggcacccagctctgtccgattccacagctagccaccccatgaatgcagcttcatatcaccaaagatcagcctactccagcggttcctaaaggctgcatggaatcccctccttcatctataccattcatgatttaaccactcctcccacccccatccccaatgttgtccatgtggctgccttaaacagcaccctggcgagcctcatcctagagtcatctttgggccttcccacccctgcctggcttccctctctcactcccctgccccccactcccagaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggtctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctcatagtccctcacccttccgcggaaagagcccccttactccacctccccgccagcctggggccaccccccctcactgcatcctggggccacccccactcactgcatcctgggaaccttcgccctgcaaggcgtttgctatcttcagccactgggcggagctgcagccctggaggagggggcgggtcgaggctgcgtggtgatggggtctccgcccccacgccctgccgggcagggctggagctggacagaagccagtgcctttaagtcatttgtgtcaaaaccctctggggtccggaggccgtgcgggtgtcctcctggcaatagacactacccggttctcgcc

SEQ ID NO: 1287 - DNA, 2134 bp, Homo sapiens
ctttcatactgcctcctcccttgtttttctgtctcagagagatagtctgtcctaaatatcccatgtagcccaggccactgaattaaaacggagcgtattcgttctctgccccaccccgcaactcctgaaagcggcgcaactcaattacttgatccttatatgccccacgcgggactcatactacgtttcccgtgaacacgtgcagtccaaaccccgcccctgatatttatctcagtggacggtggccggaaaaggacaatggtttccatgtcagcggataaacgctctcccctcggctcccggacgcgacggaggtcgtagtagtagtgagtacgtgctgaggagcaaaggagtaaccaagagatccagtgaccgacagagcaagagccatgccgcgccggggcctggtggctgggccagacttggagtattttcagcgtcgctatttcacgccggcggaggtggcccaacataacaggcccgaagacctctgggtatcttacctgggacgcgtgtacgacctaacgtcattggcacaggaatacaaggggaacctgctgctgaaacccatcgtggaagttgcaggccaggatatcagccactggtttgatccaaagaccagagacatccgcaagcacatagatccgctgaccggctgcctgaggtactgcaccccgcggggccgctttgtgcacgttccgcctcagctgccctgttcggactgggccaacgattttgggaagccctggtggcaggggtcgtattatgaggtggggcggctgtctgccaagacccggagcatccgcatcattaacacgctcacgtcgcaggagcacacactggagctacacgtggaaatatgaagggaagaacctgaacatggattttaccctggaagagaatgggatccgggatgaggaggaagaatttgactatctcagtatggacggtacacttcacacacctgcaatacttctgtacttcaatgatgatctcacggagttgtaggcaaggagatgtacactcgtgtagactcaagacgtatttcgagtttggctttttctgtgccttgaggaaaagtggtggggccgaggggtgcctggacccagatctccactcctctccaggagctagcctgtgcccttctgaagtgtaaaggccctattccctgccttcattacagtttgctctgagaaaattagtgaattaatctttgggaatgatacaagaagatcaagtaccttggtttagggagatgtagaagaggatagtcagagttcaggcagaactgtttgatagttaagagagagtagttctacaggggtgagggatggaaggacttttttggcaatgatggaaatgagatgtctgcaggaagatgggatttacaaagaaataggaaatgtttatcattgaccatacaaagctggcttatcttacttgtagaagagtgtttggcagctgaaacccaagggaaagaaaggaagtgcgtcattataggcaattcaggctagatattatactaggtacttcatataccctctttttttttgcccccaacaaagagaaggggtcttgctctgtcacccagtctggagtgcagtggcaaaatcatggctcactgcagcctggagctcctgggcacaagtgatcctcccatctctgccttgagtagctgggacttcaggtgcacgccacaatgcctaattttttaattttttgtagacacagggtctcgctgtgttgcccaggctggtttcaacctcctggcctcaagtgatcctcttgcctcagcctcccaaatagcctcttcaagacaactaccccataaggtggattaccattactatgttacagataagtcctttcactttccacctagctgatcctaaatgttccttcctcagggaggtcttttctgatttcttggtgggtcaagactttctgataaatcagttagcaccatgcattttccagagtttttattacaattgtaaaattatggctgtaataggctggctgcgctgctagattgtaagctcacgagggcagagatcttgttcacatcttgctcactgctatattctcattgctgagcacacagttgcagctcaataaattttgaatgaactcc

SEQ ID NO: 1288 - DNA, 2823 bp, Homo sapiens
aacgaacagaagggcgagagaattggcaggatccgtctcctacctcttcctaggcccacagccagtgcctttggagtactgaggcgcgcacagagtccttagcccggcgcagggcgcgcagcccaggctgagatccgctgcttctgtggaagtgagcatggttgggcagcgggtgctgcttctagtggccttccttctttctggggtcctgctctcagaggctgccaaaatcctgacaatatctacactgggtggaagccattacctactgttggaccgggtgtctcagattcttcaagagcatggtcataatgtgactatgcttcatcagagtggaaagtttttgatcccagatattaaagaggaggaaaaatcataccaagttatcaggtggttttcacctgaagatcatcaaaaaagaattaagaagcattttgatagctacatagaaacagcattggatggcagaaaagaatctgaagcccttgtaaagctaatggaaatatttgggactcaatgtagttatttgctaagcagaaaggatataatggattccttaaagaatgagaactgtgatctggtatttgttgaagcatttgatttctgttctttcctgattgctgagaagcttgtgaaaccatttgtggccattcttcccaccacattcggctctttggattttgggctaccaagccccttgtcttatgttccagtattcccttccttgctgactgatcacatggacttctggggccgagtgaagaattttctgatgttctttagtttctccaggagccaatgggacatgcagtctacatttgacaacaccatcaaggagcatttcccagaaggctctaggccagttttgtctcatcttctactgaaagcagagttgtggtttgttaactctgattttgcctttgattttgcccggcccctgcttcccaacactgtttatattggaggcttgatggaaaaacctattaaaccagtaccacaagacttggacaacttcattgccaactttggggatgcagggtttgtccttgtggcctttggctccatgttgaacacccatcagtcccaggaagtcctcaagaagatgcacaatgcctttgcccacctccctcaaggagtgatatggacatgtcagagttctcattggcccagagatgttcatttggccacaaatgtgaaaattgtggactggcttcctcagagtgacctcctggctcaccccagcatccgtctttttgtcactcatggtgggcagaacagcgtaatggagaccatccgtcatggtgtgcccatggtgggattaccagtcaatggagaccagcatggaaacatggtccgagtagtagccaaaaattatggtgtctctatccggttgaatcaggtcacagccgacacactgacacttacaatgaaacaagtcatagaagacaagaggtacaagtcggcagtggtggcagccagtgtcatcctgcactctcagcccctgagccccgcacagcggctggtgggctggatcgaccacatcctccagactgggggagcgacgcacctcaagccctatgtcttccagcagccttggcatgagcagtacctcattgatgtctttgtgtttctgctggggctcactctgggcactatgtggctttgtgggaagctgctgggtgtggtggccaggtggctgcgtggggccaggaaggtgaagaagacatgaggctaggtgtagccttgggtgaggggagggcatccctggtcctttgaaggttctccccaccccagcacacgccacccctctgttctctcttcagctccacccgccactgatcctgcaacttgcttctttctattctctgcctctgtttagaaatcttcacacaccactgaggcttcttgacttgccccttgtgacttgaaaccccagctcagatacaaattttcacctgccagccctgcctcctcctttctcccttttcctagacacaggactctgacaacttcatcctccttgtttagatgacttcccagtttccagtccccatttctccttctatcacttttcataaaaaaactcaggaaatatttgacatatcttccatttcaaattcttccattttatgcagatatcttgcccttcctataagctctcctcaaagctcaggaaacctggtctgctctcctgcatttagggaaggagaacccctgccaagacctttgctcactgcctgagaccccttccttagagagcacctcctttgctggtcagacatggagcctgcagttggtcacagatgatactgctttatttcagtttttacagttgccttcttaagattcccgtcttataaatggagtacagggaacctcaagtagtgaagtggaaatccatgtgtaaggctttgtggcttcaggtaccagtggctaaggtagttttaaagactttgttgattttagaaaaagtccatcttccatcccctacatggcagttaatacccttctatatggtaaaaccttagagattaccttaatctgctaggaacagaagcaagaaaaaccatggcgtaaacacccccagagtttttgttcatttgtttcatctttcttgataaagcccgaaggtagcccattcagggctgttgtggttggttgctccatcatgtcatcaatagcccatatcttttcttttttatcttccttagtataacaccaaactacctctctgatagctggtgttcatgaaatattttaccttcaaatgattgtacctttttatttgctttagagttctgaaataaaatgaaattccactgt

SEQ ID NO: 1289 - DNA, 1850 bp, Homo sapiens
cacttgaccagtgagcgcaagaggctgagcctcagctgtgctttttgtccctttcaggtgcccggctcccctgggcacccagagccccccagataggccggtggaggaggtggaggagctgtccccccaaaactactggcctgtggtctggactccagggccccatttctgatgtcgccaggtgtgcctgagcccatcggggccaggcctgaggaagtgtttcttgggaggatgggatgaccccctgttcccaagagatggcagcacagtggaggccatggtggaaaaggccctgccatggggtccttgagggccaggacagcctgagggagggatggtggccactgcccacaaggggcctggtgggaacgggtcccaggacagactcatagctagaccccgttggcggcctctgtgttgaaccagaactcattaaacacctcctcttgcttcatcctggtgtgcctctttcatggcagggccctcagccaccctgctagatggttaggaccaaggctctgttctcctggaagccaaggtcggcacattggtcttgggcttctcttctctctgggtttcttgttcactaaggagtaacacagaggtcaggcagagaatgggggtctcgcaggctagggacctcagggagaggcctctgttgcccttttcagcaaggctggaaatgggatatgggcaggggacgtcttctctgacttcaccctagaccttctggctccaaatggggcccatggccttgagcacctgggaccagctctttccaccacagggcattgggcactgggcactttcttatcgagatagtcactcccacgtctggttcgtgatgggcttggccctccagctcagcacaactgcaagaatggattttgtattctctagacggacactgtccaagatggtagccattggccacatgcgacacatttttaatgaattaaaattaatcaagactggaaatgtcggccaggcctggtggctcatgcctgtaatcccagcactttgggaggccatagagggcggatgacttgaggtcaggagtttaagaccagcctggccaacatggtgaaacccatttctactaaaaacacaaaaattagctgggcatggtggtgtgttcctgtaatcccagctgcttgggaggctgaggcaggagaatcgcttgaacccaggaggcagagattggagtgagctgagatcatgccactgccctccagtggccaccacatccggcaaggcagatgggaccatttccttcatccagaacgttctgtggacatcactgctctaggttcctcccttatggagtctcacaagactgtctagccagcaagatctcttttccaaccaggccaggagcacctctccacccactgctgctggtctgaccgccttcctggaagtccctcttgaggcaggccctggagttagaagctgggcagaggcacccacagccttatcctttgccaatctctgactcaatgccacggccactgtagtgagctgaaccacctccagcagtcccctggcagaagcacctggaaaacatgcaatgggaaccttcaccctgaggccaggcccttcccatgctacccaacagtagacaggacaccctgtgttgttggctgcaccggggtgctgggatctgtggatccctggggcctggaagccactctcagcacatacagccactgtgttccgaggtccagtcagctggccgggaaggaattcaacacagccaaggacagaggtccatatgatgacgggtggatgctcgtgtgactttgctgaccttttatgttttctatgggcaataaaggccaagagagctc

SEQ ID NO: 1290 - DNA, 2645 bp, Homo sapiens
agaacatgcagagacccatggatgaactgtgtttctagatttttcctccagctttcctgagagaaacaggtcaaaatgagcaagagacgcatgagcgtgggtcagcaaacatgggctcttctctgcaagaactgtctcaaaaaatggagaatgaaaagacagaccttgttggaatggctcttttcatttcttctggtactgtttctgtacttatttttctccaatttacatcaagttcatgacactcctcaaatgtcttcaatggatctgggacgtgtagatagttttaatgatactaattatgttattgcatttgcacctgaatccaaaactacccaagagataatgaacaaagtggcttcagccccattcctaaaaggaagaacaatcatggggtggcctgatgaaaaaagcatggatgaattggatttgaactattcaatagacgcagtgagagtcatctttactgataccttctcctaccatttgaagttttcttggggacatagaatccccatgatgaaagagcacagagaccattcagctcactgtcaagcagtgaatgaaaaaatgaagtgtgaaggttcagagttctgggagaaaggctttgtagcttttcaagctgccattaatgctgctatcatagaaatcgcaacaaatcattcagtgatggaacagctgatgtcagttactggtgtacatatgaagatattaccttttgttgcccaaggaggagttgcaactgattttttcattttcttttgcattatttctttttctacatttatatactatgtatcagtcaatgttacacaagaaagacaatacattacgtcattgatgacaatgatgggactccgagagtcagcattctggctttcctggggtttgatgtatgctggcttcatccttatcatggccactttaatggctcttattgtaaaatctgcacaaattgtcgtcctgactggttttgtgatggtcttcaccctctttctcctctatggcctgtctttgataactttagctttcctgatgagtgtgttgataaagaaacctttccttacgggcttggttgtgtttctccttattgtcttttgggggatcctgggattcccagcattgtatacacatcttcctgcatttttggaatggactttgtgtcttcttagcccctttgccttcactgttgggatggcccagcttatacatttggactatgatgtgaattctaatgcccacttggattcttcacaaaatccatacctcataatagctactcttttcatgttggtttttgacacccttctgtatttggtattgacattatattttgacaaaattttgcccgctgaatatggacatcgatgttctcccttgtttttcctgaaatcctgtttttggtttcaacacggaagggctaatcatgtggtccttgagaatgaaacagattctgatcctacacctaatgactgttttgaaccagtgtctccagaattctgtgggaaggaagccatcagaatcaaaaatcttaaaaaagaatatgcagggaagtgtgagagagtagaagctttgaaaggtgtggtgtttgacatatatgaaggccagatcactgccctccttggtcacagtggagctggaaaaactaccctgttaaacatacttagtgggttgtcagttccaacatcaggttcagtcactgtctataatcacacactttcaagaatggctgatatagaaaatatcagcaagttcactggattttgtccacaatccaatgtgcaatttggattcctcactgtgaaagaaaacctcaggctgtttgctaaaataaaagggattttgccacatgaagtggagaaagaggtacaacgagttgtacaggaattagaaatggaaaatattcaagacatccttgctcaaaacttaagtggtggacaaaataggaaactaacttttgggattgccattttaggagatcctcaagttttgctattggatgaaccgactgctggattggatcctctttcaaggcaccgaatatggaatctcctgaaagaggggaaatcagacagagtaattctcttcagcacccagtttatagatgaggctgacattctggcggacaggaaggtgttcatatccaatgggaagctgaagtgtgcaggctcttctctgttccttaagaagaaatggggcataggctaccatttaagtttgcatctgaatgaaaggtgtgatccagagagtataacatcactggttaagcagcacatctctgatgccaaattgacagcacaaagtgaagaaaaacttgtatatattttgcctttggaaaggacaaacaaatttccagaactttacagggatcttgatagatgttctaaccaaggcattgaggattatggtgtttccataacaactttgaatgaggtgtttctgaaattagaaggaaaatcaactattgatgaatcagatattggaatttggggacaattacaaactgatggggcaaaagatataggaagtcttgttgagctggaacaagttttgtcttccttccacgaaacaaggaaaacaatcagtggcgtggcgctctggaggcagcaggtctgtgcaatagcaaaagttcgcttcctaaagtt

SEQ ID NO: 1291 - DNA, 2438 bp, Homo sapiens
attgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattccatggagtctccctctgttgcccaggctggagtgcagtggcaggatcttggctcaccacaacctccgcctcccttgttcaagtgattctcctgcctcagcctctcgagtagctgggactacaggcgcacaccaccatgcccagctaatctttgtatttttagtagagatggggtttcactatgttggccaggccggtctcgaactcctgacctcatgatctgcctgcctcaacctcccaaagtgctggaattacaggtgtgagccatcatgcctggcctaatttgtatatttctaatgactcatgatgttgactgagcatcttttcttttcttttcttttttttttttccttgttttttgagatggagtcttgctctatagcccgggctggagtgcagtggcgccatttcagctcaatgcaacctctgcctcctaggttcaagtgattctcctgcctcagcctcccgagtagctgggattacaggcacacaccaccatgcccagctaatttttgtatttttagtagaaacaggttttcacaatgttggccaggatggtctccatctactgaccttgtgatctgcccccacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcaccaccctagcaatatcaaccattaaccttccctctacacttatcatcttcacaattctaattctactgactatcctagaaatcgctgtcgccttaatccaagcctacgttttcacacttctagtaagcctctacctgcacgacaacacataatgacccaccaatcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgctcattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctatatgtctccatctattgatgagggtcttaaac

SEQ ID NO: 1292 - DNA, 1864 bp, Homo sapiens
gtttttgtgccctgccaggcaccgtggtctcatccgcctgcacagctgagtccagtgggagctgacgccatgaccctcaccctctcagtcctgatttgccttgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttcttttcgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctgcaggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatcaatgagctgagaaaactgaaacagaaattagagcatggtataaatttggaatgataatgtaaatattacacattaaatgatgaaatcggaaaactac

SEQ ID NO: 1293 - DNA, 2065 bp, Homo sapiens
ctgttactgcacacatttacagagtgagtgcatcgcttaggctctctcgcttctctacatggcccggtgttccactgaagtgtgtcccgagatgtttccagaaggaggatgacgagggtggcgctgaagaggctctgccatgggaaccggagccggagatgccggccagaactctgggttctctggaagtggtgggaggaaacccgcaggagggaagaggccatctctcctttaactcctaggggaacagaccgcaggggctgagggtgctagccctttctgaagctgagagggagccggaaaggaagggactcaggggatctcatgggagccagaagggcccagacttaggatccgaaattgtgcctatgagagtggtgagcattggagactctcccaggggttggttggtggcaggcgacatgaatctgtgaatgctgacttagctttagagggactgagggtgaggatgtcacagagcccaagggcaggattcagagcccagcctccaggaggacaagaatggggacattccttggggacaaagttgggctgtcagtcactgtctcagaccttctctccggcctgtctggttgcccgtctccgctgtgcgcctgcagaccctgcctgatcattgctgctcatggtttcaaaatgtgtttcctcagatggtggccccaggccctgagccttgtgatcttctggatatagagctcatgcagccagctaaccagagaccctgtgcctcagccccaggccctgagccttgtgatcttctggatatagagctcatgcagccagttaaccagagaccctgtgtctcagcctcagatcctagaaagagaatgtgattgttccagactggccggggattcgccccctagtttagcgggcttggccgcgcggtaggcccacaggaacaacgcaggggccctccacttcccctccagctgtgggcaagggcagttcttgcgtcccaaagagggaacctaaagaaaaaagggaaatatgggaggcaggagactgggtggaaccagaagtggaggatggggccacggagacctcctgaagctgggctcgcagggagttcaggggagagccggaaggagtggggtcggattagggacaacacaaggacccacacccacgagctgtacagttcattcctagataacgacgactggtttgggcttttataaactaaaatttcccctgaagataatctataacccaactgccgctgatacagtgaaaaagtctggcttctctaggaagccatttagctcaaggtaacctcaagaagagaaacagagaggtttaggagtgacaaagttttcatggccaagatggaaatgtcctgcctagaaagaggccataaggaaaaagtctagaagtgtatatgtgtgtgaacctggaccccaccgcaccccagtgaaatcagaatctcgggggggtgggactggccaggtgattcccatatgcacccaggatttcaaatcactggcctaggaacagctgacaggtcattccccttttctccatgacaggagctcagatgtttggagattgccaatagaagtcaatgtggcagagcttgctctgtttcctgggccgtgggctctgggaactggcatctcagagcctcatggcccgagaagctgtgtagctacccctgttcctattggtgaagccacccagcacccttagtggagcagctctgtcctatccccactgggtgttcaggcagtaaagatggggggttatgctcaaagagccacaaccatcctggttttctggaactatcccagtttcagtactgaatgtcctgtgtcccaggaaaccctacagtctgtgtaaactggggcattggtcacacagtggcactcagctgagggtcaggagagcccagctgacgtctttcagccctgacacaggccccacacccacgttccacagcggctcctggcctgggagctccaagcctggcatcattctcggcgctgggctctcccttgtcctggagaatgttgacttttctcacacccacacatacacatgcacaagc

SEQ ID NO: 1294 - DNA, 1756 bp, Homo sapiens
cgcggcggggagttgttgctgccgcgatgctggtggcggcggccgcggagcggaacaaggatcccatcttgcacgtgctgcggcagtacctggatccggcccagcgtggcgtccgcgtcctcgaggtggcctcgggctccggccagcacgcagcgcacttcgcgcgggccttccccctggccgagtggcagccgtcggacgtggaccagcgctgcctggacaggtgcggcccccggggcggccacttctatcggtgcggcggtccggggcctcaagagcccacggcccgcagccccggaggaaaaggatgcggctcgggctctgagggtgcggggtgggagcctgggggtgcccccggggcaggccctagctgtgcggcccccgcggctgcggaagtgggtggacctcggggtcccccttcccagccgctttggtctccgctcctcaacgtgccccccagcctcccctaagaaattctgtgggggcgtcggaaaggcgggtgcacaggactcggccccctcccaagcgttcgcctcctgcagcatcgcggccaccacgcaagcccagggcctgaccaacgtgaaggccccgctacacctggacgtgacgtggggctgggagcactggggcgggatcctgccacagtcgctggacctgttgctctgcatcaacatggcccatgtcagccccctgcgctgcacggaggtctgtggggagcccagcatgggtgtctgccgtggcaccactcaccctgcatgggggcagctgggatgccagatttgcccccatcacagtcggggtgagggtctccagcctcccccatcacagtcggggtgagggtctccagcctcccccatcacagtcggggtgagggtctccagcctcccccatcacagtcggggtgagggtctccagcctcccccatcacagtcggggtgagggtctccagcctcagggcctggcttctgttgggggcagcacctcactgccgtcctgttcctactcaccaggggctcttcagagcagcaggacacctgctcaaacccagggccctgctcatcacctacggggtgagtgggcctgtccacggcgggcctcccgctcccagtcctagctgctgtctcctgccctgctgagagtcctccctcctgggctccctgccccccgcccagccaccagcacggcctcccctccacttccagtctgtacccctccctgggtcatctgccagcctccctacccccttgcccaccaggctggccttggctgactccctcttggggacagggagggggtgccctttcattctccaaaccccagcctgcaagtctgtcccaggctctctgggaaataccccgaccttggtccagtgggctgtgtccccatgcccacagccctatgccatcaatgggaagatctccccccagagcaacgtggactttgacctgatgctcagatgcaggaacccagaatgggggcttcgggacacagccctcctggaggacctgggaaaggccagtggcctgctcctggagaggatggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccgg

SEQ ID NO: 1295 - DNA, 2729 bp, Homo sapiens
attcgatgcacccggaggaacggaaggcaggattgcagcttcctcagtgcaacctccaaacaggaaatctgagatgtataacatcttatagtttggcttgtcaacgttggtcatgcggtggccccaaaataaactccctgcttcaaaggacagcgtttcagaactgcctggcagagcagccagaagcttggggccagggcagaaggaaaactcggggagcatgttctgaattaagacactttcaagaaaatcctttgtattacccctgaattgtacccttgtttcagagcctaacagggttttctgatttgctgttccctcctccccactgggtgtctgttctggaggccagggtgagaggaggaggaggagtacagcctgtacagcagcctgagcgaggatgaactggtgcagatggccatcgagcagagcctagcggacaagacaaggggcccaaccactgctgaggccaccgcgtctgcatgtaccaaccgccaacctgcccatttctacccatggaccaggtccactgcacctcctgagagttcgccggcccgggccccaatgggcttgttccaaggggtcatgcagaaatacagcagcagcttgttcaagacctcccagctggcgcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaagcctgtgagcgcaagaacgcggaggccgtgaagattctggtgcagcacaacgcagacaccaaccaccgctgcaaccgcggctggaccgctctgcacgagtctgtgtctcgcaatgacctggaggtcatgcagatcctggtgagcggaggagccaaggtggaatccaagaatgcctacggcatcacccccttgttcgtggccgcccagagtggacagttggaggccttgaggttcttagccaagtacggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcgcccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcagttctgtgagttcgtatctgccccagaggtgagccgctgggcggggcccatcatcgatgtcctcctggactacgtgggcaacgtgcagctctgctcgcggctgaaggaacacatcgacagctttgaagactgggccgtcatcaaggagaaggcagaacctccaagacctctggctcacctttgccgactgcgggttcgaaaggccattgggaaataccgtataaaactcctagacaccttgccgctcccaggcaggctgattagatacctgaaatacgagaacacccagtaactggggccacggggagagaggagtagcccctcagactcttcttactaagtctcaggacgtcggtgttcccaactccaaggggacctggtgacagacgaggctgcaggctgcctccctctcagcctggacagctaccaggatctcactgggtctcagggcccagagctttggccagagcagagaacagaatgtgtcaaggagaagaatcatttgtttacaaactgatgagcagatcccagaccttctctaccttcaggaatggcagaaacctctattcctggggccagggcagagcttgaggtgttctggggaaggtggtgctcagagccttccctgtgcccctccacttgttctggaaaactcaccacttgacttcagagctttctctccaaagactaagatgaagacgtggcccaaggtagggggtagggggagcctgggtcttggagggctttgttaagtattaatataataaatgttacacatgtgacacctgcccagtg

SEQ ID NO: 1296 - DNA, 1804 bp, Homo sapiens
tgtcagggagaagttagatgcacataagataaaagaataaaaacattttaaagatgaataacaaaaattcatgtagttgtactggagtgaaaattaataagctaatcttgatttttacaattgaattttctacacagtaagtgtaacatacaaataacaggtttaatataattaacattcatgccaaaaggaaaacagaagataagtaaacagaaaaatgtagctttttcaaaatgagtgcattagtgaaaaatcaggaattcagacaaacctaatattcataattcttgaggtactggttaaattaacccattttataggtgaggaaactcaaagtaatttgcttttatgtactgtaaaatgagagacatacattactcacaagtccgggcgcggtggctcatgcctgtaaatcccagcactttgggaggccgaggtgggcggatcacctgaggttgggagtttgagaccggcctgaccaacatggagaaaccgtctctactaaaagtgcaaaattggctgggcatggtggcgcatgcctgtggtcctagctactcgggaggctgaggcaggagaatcgcttaaacccgggaggcggaggttgcagtgaaccgagatttcgccattgtactccagtctgggcgacaagattgaaactgtctttaaaaaaaataaataaatactcacaaatgcctgttaccagggctttaggaggaaaaaaaagcaagcccaacactggcaggatccagaaaagaatgatacgttgctgttttgagtaaaagtgatataactcttttggaaatttgtaactgtcctaagaagaaatacacaaagtgtctttcataaagtttcagctttactgcagtgtgcctttattcccagccactgggaagctgaggcaggatgcttgagccaaggctgtagtgtgttgtgattgtgcctgtgaacagctattacactccagccagggcagaatagcaagaccttgtctcttaaaaaagttgcagcattatttacaaagcagaaagtgatggtcacaatgaaatacgctccctttgagaacatttatgaaactaatagcatagcgaagaccaaccatattttgtggagagataaggaaattatttttattttactttttattctaaagctgggttagagataaggaaatttagatgactagggtgagattatgtaagatggtttttccttctgctttgctgtgtattataatatgctatgacacatgtgctacctttttttcttcagtgatcgttgttctttttatatttttgagacatggtcttgctctcttgcccaggctggagtgcagtggtgcaatctactcactgccacctctgcctcccgggttctggcgattgtcgtgcttcagcctcccaagtgggtgggattgcaggtgtgcaccaccacacccaactaatttttgtactttggtggagacggtttcaccatgttggctgggctgaactcgaattcctggcctccagtgatcatcccaccttggccttgcaaagtgctgggattacaggtgtgagccactgcctagcccagtgatccttgttctgaattactactgttatattcagaaaaaattaagttttagtgtcattttgttgaaaatgctgcagttatgtcaggctgttgtgtgttagagtacacgattggcaagtttggtaatgtgtcttaattaaatttttacacacaaagctctgaattagtgctcagtgttaattttagctattactttatactaaaaaagtcaataaaattagacttacatggt

SEQ ID NO: 1297 - DNA, 2875 bp, Homo sapiens
atttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctttctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgcagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagtagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgag

SEQ ID NO: 1298 - DNA, 2276 bp, Homo sapiens
tgtcatgccatctcttcctctggccaatgctaggagctgggccctccttggggagaaacctgggtttcctgagtcaagggaccagaagcgggccacattcctgaggcaggagtggaaggcagagggcagaggaggttgaggagacagaaggacaggcctctcagggcactgcccctccttccctccttctccacctcacatcatcctgcctgggtcctcagaggagccctgggtagcccgagatgggtagcattcctcggtcaaggcatcagcacagaggggcacaggagtctgggaccatcagaagagaatgcagtggtcgggagagggggtccccagactctgaaccccatgctgagctggggcttgacccttcacttctcccgggagaaggtctcctgtccccgtggctgctctgtttcccatgcccagctcagactgagctcacacaggtgagaaaggctccagctgcatccagtgggccccagcccaacaggcgcatgttttcctttcttgcctcggtccccagggccagctggggccagtgagggaaagggctgcagcaggggagcccttttcttctctcttcctccctgaactccaccaccacggtagagcatctttcccttccctttgctttgcatcctgtttctccattgtctctcctctcatatgtctcacctgtctctccctcccctaccttcaccccgtttctgccatcattcccctgccttccccttctgcctcctgagcctgcgtcactcacctccctgtcccagcatcctgggccatccctaagagctgacctggtcttggccagggccaggacaggcagactgacggacatccagtgaggtagcagagccctgggctcccaccccatttcctactccctgcagagccttcagtggggacttggacaaaggtgagagagggatggagggaggggaagaaagtcctgaagcctgggctcccaatgctgcccagggctgcagaggcaggaacttcggagtgtaggtggacacactgcactgtgtctctgacgtaggtgtgattgctcccatgaggaggacagctccacagtttcacttaccgttgtccattttgttttgattttcggcagctccatcctggaattgttccccaaattattatgcctggatggccagcagtcacccagagcaactttatgtggtactgaagcccacaagaggttaccaacctgtaaggtgagaagagaggatccagcagggtggtgcatgaggaagggggggtaccatctgtggtcctggggactctttattccagggaagcttctttggatctgagatgttgaagaatctggtcctgcaattcctgcagcagtaagtatccctgggaatctgaggcaagagaaggctaggtcagatgaatttacccaagtacaagtctgcctacagtcagactttcaagactcatttggcacccaggccacagagatagcctgtcctcactggtctccaacaggtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtggaaggacagtctcagggttctgttctcgccttcacccggaccttcattgctacccctggcagcagttccagtctgtgcatcgtgaatgacaagctctttgtgcgggataccagccaccaagggacccagagtgccttgttcaccctagtgcccacagccttctccagctccgtgcctgccttctcccaggagcagcagaaaatgctgccttcgtaacaaccagtgtgactacgtcagagctcctcatgttcttgcatggcccaagatgtatttccctgtgactgaaccaggagatctggctggggctaagaagccgaagcccaactcacagggctgactctcatccttccaaaggggccagttgttctgtgcacttgtccacccctgttacccccaggatctctgttccttttcacaataaagtatggtgtcttgttatgtc

SEQ ID NO: 1299 - DNA, 2312 bp, Homo sapiens
acatttcaccatggaatatgaagtcaagaaagggaagaagggctttgtatcccccatccgaaggctggtgttccccaaggccgggcgccgggcagcctgtaggagcagcgtgagccgccggcccctgcactcgatgcccctttatccccccgactacctcatcgacccccagattctgctgtgtgactacctggagaaagaggtcaagttcctgggccaccttacctgggtgacttcctcactgaacccctccagtcgggacgagctcctgcagctgctagacaccgccaggcagctgaaggagctgccgctgaagaccacggcggagcaggacagcatcctgagcctgtctgcccgctgcctgctgctcacctggcgcgacaatgaagagctcattctgcgaatccctacgcacgagatcgccgccgcctcctacctgcaggacgacgcgctgcacctgctagtgctcaagaccggtctgggtgtggacccggtgccggccggcgtggatgccagcccaggcggcgcaggacgcgaccccggcccgccaggcggggcgcccgagaagcggcgggtgggcaccgcggagcggcgccacaccatctgcagcctggactggcggatggggtggggtgggggcgccgcggaggccccaacccgctcgacccgcaggaccccagccccgacgcctactgcaacctggtcatcctggctgtagccaacagggacgctgcagaggagtcctgcgcactcatctgtcaggtcttccagatcatctacggggaccagagtattgagtgtgtggaccgggctggctaccactacacatccacacctgaacggccatggctctgcagccgcataatggctcccaggacacctttgaagcatgttacagcggcacgtccacaccttctttccatggctcccactgcagcggcagcgaccacagcagtctgggcttggagcagttacaggattacatggtcacgttgcggagtaagctggggcccctcgagatccagcagtttgcgatgctgctgcgggagtaccggctggggctgcccatccaggactattgcacaggcctgctgaagctctacggagaccggcgcaagttcctcctccttgggatgcggcccttcatcccggaccaggacatcggctacttcgagggcttcctggagggcgtgggcatccgcgagggcggcatcctcactgacagcttcggccgcatcaagcgcagcatgagctccacgtcggcctccgcagtgcgcagctacgatggcgcggcgcagcggcccgaggcacaggccttccaccggctgctggctgacatcacgcacgacatcgaggcgctggcccccgatgacgacgacgacgacgaggatgagccccggggctccaggggcgggagcgacgccgcagaagacaactacctgtagccaccgcccctgcggacggcgtggctcagcagcccacctctgagtctcagctttgcttcggggaccctatccccagggcccccccatcacacctggcggggccggggggtcttcactccagggtctcgctccctgcccttggggcccggggccatgcagtacctggagtgtcctgcagggggaaagcgaagccgggccctgaagtccggggcagtcacccggggctcctgggccgctctgccgggctggggctgagcagcgatcctgctttgtcccagaagtccagagggatcagccccagaacacaccctcctccccgggacgccgcagctttctggaggctgaggaaggcatgaagagtgggctccacctgctggccgactgagaaaagaatttccagaactcggtcctattttacagattgagaaactatggttcaagaagagaggacggggcttgagggaatctcctgattctccttatatgacctcaaactgaccatactaaacagtgtagaaggtctttttaaggctctaaatgtcagggtctcccatcccctgatgcctgacttgtacagtcagtgtggagtagacggtttcctccacccagggttgactcagggggatgatctgggtcccattctggtcttaagaccccaaacaagggttttttcagctccaggatctggagcctctatctggttagtgtcgtaacctctgtgtgcctcccgttaccccatctgtccagtgagctcagcccccatccacctaacagggtggccacagggattactgagggttaagaccttagaactgggtctagcacccgataagagctcaataaatgttgttcctttccacatcaaac

SEQ ID NO: 1300 - DNA, 2129 bp, Homo sapiens
ctttgctcaggacctctggatgccaggggtcgtatcaggggctctaaggtaattccacatgcccagcagattcagcttagagaaacggtgctcacagtgctggggtaggagcagagaaggctaaatgaaggactccggagagctgcaggtggatctggaccaaatccagaacccaacgccttactccctcctggggagagagctgggcagagacttggggcgggcagtgaggtggggataggtgagcagcactcgtggtgagtggccccagtgtgatttaggaggggtgcagtgtgggatcccagggacatgaccagtcagccccgccctggctttaacatgggggtgcctggcagtggtggctagagaagtccagtttgccaagagaatggcacataaggcactggggtgggcacctctggggcatggacatagggagacatagggatggggtgggtcacctgcgtggaggactgggcactgaacagcacaggcccgagcccatccttgtccacgtgagcttatggcctgatgtagagaccaccaggggctccaggaaagttaagctgcatggagagaaacgatgggccagggccgggcccagggtggtttagggaatggcagtgtcctgggtagaataggaaggcctgagactgtgactgagctgacagtggggcaaagtgaaggagcccagtattggaagatcggctccacatgtatctctgcgaggagactgcaagcgagctcgtgtggaccaggcagaggcgagggctgagtgaggccagcagtggcctgggcacaggaagacggtgagtgagaagccactggagctcctgtgcaggagcgcaacacctttactgcttcattcagtttggcttcacctgcttaaaactgtaactctctagaaggctgaacagcaaaagcctccctcctgcccagccgctcagcatccccaggcaccagcactgctcccagtctccaacgtcctccagggctcttcgcttctgggctagaagcagggaaaccagagtgtgctggggaagaagaggaggaggtggaggagggctgatgatggggccacatgctgctgggatgccagctgagagcagcggagcactgctaagctaaggggctgagtgggtgcagatggagccctccgtgggctccttcaggtaccaggagccctgcctgagattcaggacacatccaagggtgacagcttgaggttgggtttttatttttttatttgtatagtacaatctctgtggtagcagaaatatatgcacaaaaaacaattcaaataagagttcagagtaaaaaaaagtcagctaagactgtatcccgcaggacatttcatatatatggatttcacagctacactcgatccacgccccacaccacatacaggctgctgtctcccacaagaatgatgatgtcaggggcatcaggaaaggtaagggccgggaaaccgggcccttggagaaccctgcccaggggaggcccagcctactcacaggatccgacactccaggcagagcagagggcaggagaggcccaaagagctaggtcaagcagctggctcccctgggaggggagccgggagacagggaggtcctcacactgcccccgtggccacgcatggctgtctgcacactccatcaggaggaagggcaggggagaagtcacatgcagtacagtgaaactcatcagtgtcacacacgcccagcaggaggggagagctctgctccacacgctggcggccttggctgctccagagcaatccgctgctccagcttcagccatgggaccaagagggtaaaggagcagcttctggaggccccaggcagaggccaccttgcagcagtgactggcgactttgcagtacatctctgctcacttgctgtcccttgggagtgagcaccgtctataacacatcgccatctacaaaagcctggtcacagtgttcaccagcacattcatgaaaatttaaatcaacattaaccaaagtacctgcaagtaacactgcttactcttgctgtttgcctcatctgactggaaaccttagcccccaaatatgaaatgccttctctagattaaaaggattcagagatgttgcactattgcactat

SEQ ID NO: 1301 - DNA, 1724 bp, Homo sapiens
ctttgttcgggtgcagttggcacatccacacagtggctcatggccgcccttgcccagctctccaggcctggccgccggctgcccccccccccaccctgttgctgtctcgtgcagcccctgcacgggagctccagcttgtgtcagcgggaagggctatttcaccataagcaacactcacactcacacggggcttggttcctgtcccccgttcaccattctcagatcccccagctggccgcctgccccctgcagagcctgaggttgtccaagccacggagccccggacgctgctgcgcctggtgtggttgtctcaactgtgagcccttcaagtggctcccaagtcctcgcaggtggcccggggcgtgcctgaaactgtgctgtactcaggctctgtgttaatggctccagacctgcaaacggtgtttggccaggatcacagggcccttggtgggcagcaggtctgtttttaagctgaaaccctgtacttctgttcgcggccgtgtagagctgccccttatgccacagcttcctcatccatacgtaggggtgatgttggcaaggcctccggggcgctcaggatcaaaggcggcggcagtgtcctgccaagtgttcacagctgatgagacgtggtccctgaacacagcggttcctgttctgatcactcgagtctccgtgatgccaccgttcccagaaggcagcccgtgcagcctccgggtccccccttcagccatggcagcccgtgcagcctccgggtcgtcccttcggccaagcttccctttccttgagagcagcacgctggcctggccatgcagaacaaaacacaactcagaaatccctcctcagccctcggcagtaaaacttctgaggattcgactttttagttaatttgctcactgtggcagctcactggaaaataaatcgaggatgccaagtcctcctcttagaaaaatagcccctgcagtggggtttgctgatgtgctcatttgtgtcattgcaggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcatttttcttgacctggtataatgaaagtatttcagatatttgagtttaacccttttccagaaagtaatacatgatatggatttatttatgcattaaaagagcaaatttaaagagcaaaaaaaaaaaaaaaaaaaaaaaaag

SEQ ID NO: 1302 - DNA, 2199 bp, Homo sapiens
atatatcttagggtggaagatggataaataattctgtcacacgtgccctggcctctggagctcagctgccagtccacgtctagggaatcttagcatctgggaccaagacactttacagcaatcatcaccctttgcagaggaggtgagctcaccaggactcatctgccatttcagaccttttgctgctacctgccaggtggcccccactgctgacgagagatggtggatctctcagtctccccggactccttgaagccagtatcgctgaccagcagtcttgtcttcctcatgcacctcctcctccttcagcctggggagccgagctcagaggtcaaggtgctaggccctgagtatcccatcctggccctcgtcggggaggaggtggagttcccgtgccacctatggccacagctggatgcccagcaaatggagatccgctggttccggagtcagaccttcaatgtggtacacctgtaccaggagcagcaggagctccctggcaggcagatgccggcgttccggaacaggaccaagttggtcaaggacgacatcgcctatggcagcgtggtcctgcagcttcacagcatcatcccctctgacaagggcacatatggctgccgcttccactccgacaacttctctggcgaagctctctgggaactggaggtagcagggctgggctcagaccctcacctctcccttgagggcttcaaggaaggaggcattcagctgaggctcagatccagtggctggtaccccaagcctaaggttcagtggagagaccaccagggacagtgcctgcctccagagtttgaagccatcgtctgggatgcccaggacctgttcagtctggaaacatctgtggttgtccgagcgggagccctcagcaatgtgtccgtctccatccagaatctcctcttgagccagaagaaagagttggtggtccagatagcagacgtgttcgtacccggagcctctgcgtggaagagcgcgttcgtcgcgaccctgccgctgctgttggtcctcgcggcgctggcgctgggcgtcctccggaagcagcggagaagccgagaaaagctgaggaagcaggcggagaagagacaaggtgagcggggacagggcgttctgcacgcacctgcccaagtgccaaaacccgccgtcatctaaaggctgtgggtcccgttacgagggtttattccagcgcgaggtgtcagggcggccaccggggaacggggatcggtgaccccggtggggaagggggaagatcgttcatatggacaaaagcgggggtgcggaacggctgcattttccacggaggctagtgcacagatgtcagggttgaccggctgctgtcgttacgccctcggagcttcacatcacactgtacagagggagcggtgaccagggtctctgctgccagcgccacctcgtccaggttttcatagcgcacagggagtcgggcggatgcgcaacatctccgcacagggtcaggaagcggcggtcaggcaccgagaaaacagcccagttacgtgaggcagtgtccggggcttaacgtttccgccgagctaatagatttgggaggctccgaccctgattttcacactagcaggagggagggcgctgggtcaccctcctatgcagaagggcagccaagggtgcgcacttccccatcccctgcctggagcctcacttccagcccagcctgggcccgcagaccaccgcgggtgggagtgccgcatcggaggtgaggcctcagtgttcacccatctgttctgtctgcctcattccccaacctgagagtctttccccttttcttcatcttttttttttttttttctctagagaaactcactgcagagctggaaaagcttcagacagagcttggtaagtgacccctcttagaactatttctcctcagggccgggtccagtggctcacacctgtaatcccagtactttgggaggccgaggcgggtggatcacgaggtcaggagatcgagaccagcctggctaacacagtgaaaccccgtctcttctaaaaatacaaaaaattagcccggcgtggcggcatgtgcctgtagtcccagctacatgggaggctgaggcaggagaagggcgtgaacccgggaagcggagcttgcagtgagccgagatggcgccactgcactccagcccgggcgacagagcgagactctgtctc

SEQ ID NO: 1303 - DNA, 2994 bp, Homo sapiens
gcagatgcgctggccccagcccggggctgccgctcgccttcccccggagtctcctggacccccggagtctcctggacccccggagcgggaggcagcggccgcgcggcgctggactggagcagaaccccaggactgtgcccccgggagcgggcgcccagagaagcctccccagctttctgaggatgatatctggctaaaaagcgagggagacaactatagtgccaccctcctggagcctgctgccagctctctttccccagatcacaaaaacatggaaattgaggtgtctgttgcagaatgtaaaagtgttcctggaatcacctctaccccacatcccatggaccatccctccgctttctattcacccccgcataatggcctccttactgatcaccacgaatccctggataatgatgttgccagagagatccgctatctagatgaggtgctagaggccaactgctgtgattctgctgtggatggaacgtacaatggaacatcctccccagagcctggtgcagtggttctggtgggcggcctaagcccccctgtccacgaggcgacccagccagaacccactgaaagaacagctagccggcaggcacctcctcacatcgagctcagtaatagcagccctgaccccatggcagaggcagaaagaacaaatggccattcccccagccagcctagagatgcgctgggggacagcctgcaggtgcctgtcagccccagctccacgaccagctcacggtgttcttcccgagatggagagttcactctcaccacactgaaaaaggaggccaagtttgagctgcgtgccttccatgaggacaagaagccctccaagctctttgaggatgacgagcatgagaaagaacaatactgcattagaaaagtgaggccttcagaggagatgctggagctggaaaaggagaggagagagctcatccgcagccaggccgtcaagaagaatcctggcattgcagcaaaatggtggaatcccccgcaggaaaaaaccatcgaggagcagctggacgaggaacatctggagtcgcacaaaaagtacaaggagcgcaaagagagaagggcacagcaggaacagttgctgctgcagcagcagttacagcagcagcagcagcagcccccatcgcagctctgcacagcccctgcctcttctcatgaacgcgcaagcatgattgacaaagcaaaggaggacattgtcacagagcagatagatttctctgctgctcgcaaacaatttcagctgatggagaattccaggcaagcggtggccaagggccagagtacacccaggctgttctccatcaagcctttctacaggcctctggggtcagtcaactcagacaagccactgactaatccgagaccaccttctgtcgggggacctccagaagacagtggtgcctcagccgccaagggacagaaatcccccggtgccctggagaccccatcggcagcaggaagccagggcaacacagcctctcaggggaaggaagggccctacagcgagccttctaaacgtgggcccttatctaaactgtgggctgaggatggagaatttacgagcgcccgggctgtcctcactgtggtcaaggatgatgaccatgggattttggatcagttctcaagatctgtcaatgtctccttgacccaagaggagcttgactctggtctggacgaattgtcggtgaggtctcaggataccacagtcctggagaccctatccaatgatttcagcatggacaacatcagtgacagcggggcatccaatgagacaaccaatgccctccaggaaaattcactggctgatttttctctgccccagacaccacaaactgacaacccctcagagggccgaggagaaggcgtctccaagtcatttagtgatcatggtttctattccccttcctccacgctgggggactctccgtcggttgatgaccccttggagtatcaggctggcctcctggtgcagaatgccattcaacaagccatagccgagcaggtggataaagctgtgtccaaaaccagcagggatggagcagagcaacagggacctgaagcgactgtagaggaagctgaagctgcggctttcggctcagaaaagcctcagagcatgtttgagccacctcaggtgtcttctcctgttcaagagaaaagggatgtattaccaaagattctgcctgctgaagacagggcgcccagggaaagggggcccccccagccactgccagctgtgcagcccagtggcccgattaacatggaggagaccaggcccgaaggaagctatttcagcaagtactcggaggcagctgagctgagaagcacagcctccctcctggccactcaagaatctgacgtgatggttgggcctttcaagctgaggtccaggaaacagcggacttcgtccatgattgaggaagagatccgagcagctcaggaaagggaagaggagctgaagaggcagagacaagtcttgcagagtacgcagagccccaggacaaagaatgccccatcactgccctccagaacatgctacaaaactgctccagggaaaatagagaaagtcaaacctcctccatcccccaccactgaaggccccagcttgcagcctgacttagcccctgaagaggctgccggaacccagcggcccaagaatctgatgcagaccctcatggaagactatgagacacacaaatctaaaaggcgcgagagaatggatgatagtagtgtcctcgaggccacacgggttaatcgaagaaagagcgcactggctttgcgctgggaagcagggatctatgccaaccaggaggaagaagacaacgaataaacttccttcaacccaggaagcgtctttggtgcttgggagaccaagaaaccaagaaattaacaactgaaagcattttaatggactatttattaaagtgcaaacaaactcagcaatccttatgtagaccagaagctgcaatatac

SEQ ID NO: 1304 - DNA, 2306 bp, Homo sapiens
gtcacatactcgtcctgagccggcttcagcctctccgcgcagaagtctcccggagccgacttctgagagtcgagtactcctatgtgaagactaccaagctcgtgttcaagggaaccaaggcgaagaggcgagatggaaagaaagtatcaaggagtgagctgaagccactgcccttgagaaccctctcgaggagtctgggctcatgaggatgccagaataagtggcaggtatatcctgaatgaatgtgagatttttactctgtgaatttcctgtgaggagtgtaagaagaaaaagaacaaagataagaaaagaaaaagagaagaagatgaagaaacccagcttgatatgttggaatctggtggacagtaacaaactttggtgaaatttcaggaaccatagccattgaaatggatgagggaacctatatacatgcactcgataatggtctttttaccctgggagctccacacaaagaagttgatgagggccctagtcctccagagcagttttcggctgtcaaattatctgattccagaatcaccctgaaatctggctatggaaaatatcttggtataaattcagatgaacttgttgttgggcgttcagatgcaattggaccaagagaacaatgggaaccagtctttaaaattgggaaaatggctttgtcgacctcaaatagctgctttattagatacagtgaagcagaggacatagaagcaaaaagtaaaacagcaggagaagaagaaatgatcaagagtctcagtcatagcctgcctttatctctgaagggaccaggcgacccacggagtgcctcggcagccttgttattgcatgcaatcttcacagacaagatctcactgcaaccaggtttctacaggagcacaggtgtgacattatagtgatgacatcattctcagagaaaattcattttacgcactaaggacacacagatacaaggaggcttacacaaagggaatggacctttccacaacacagatgtgcaaggccctgccactttgcttcaattcctgaaaattccttggtaaacatggagctactctattcctgacactttcaagaaatagttattgatcctctcagcgtccacaatgttaatacaagcccaacattctttaatttgtgttttgttttttggaggcacagtcttgctctgtcacccaggctggtatgaagtggcacgatttcagctcactgcagcctcgacctcctgagctctagcaattctcccatctcggccttccaagtagctaggactgcaggtgtgtgccaccacactcagctaattttgtttatttttttgtagagaaaacgtctcgctatgttacccagactggtctcaaactcctgggctgaagcgatcctcttacctcggccgcccaaagttctgggattacaggtgtcagccactgttcccagccctttaattctttacttggggttcaggtgacaacatatttcttatttacaaatcttacttaatctcactgatgctttctgtcattggctaactgatccaccttgaatgaagcctcctccaacaagtctggaatctgtctaaatctaaattaacaggtgcgcctatgaattccctcagagaacacactgtggatgctttagcaacctcttaccatgcctcctgaagtatctggattgcatatggtggccataagtagtccatgggcttctgatgtaaaaaacaaacctgccccttttcactgtgttctgtacagcatcagggcagttattgctgaccacatactggaccctctggaaacagagggctctgcatccatgtccacgagccttcatgcccatctggccatcaggccttgggaagcagcaccccacagccttggcacagctacagagacctccttgcctcaggatggagtcaaacctggaccccctgccattctcatctgcaggaaacactggcctccttcatcctcaggctgtgttgctggaagtcacccatctccgaggccccttgggatcgactgagtgaccagcagtgaagttcatccaccttctgaatggatgccatcatctgaagtgatggagctcagtgggatgttgttgcggtcttccctcccttagccaggatgtccctgataaaggatgacacccaagcctcagcacaactggccaaacttgaggtggtcatctcagcactgatgctgggccaacaattagccccatttgtacatttttacaaatttttggcaattgccaagaattatccaccttccctccccattgaattaaagaaacttcttgcctcatgg

SEQ ID NO: 1305 - DNA, 2419 bp, Homo sapiens
actcccggctgctggttctctgaacaccaggctggcagtcactggaaactaggccgatagagcacccaccctgtgggtgcctcgttctgcctcctgctcctcgggcccagccgccctgccagtcgggctgggttccctcttgtgtctttcctgagtccttccggggaggacgaggctgtcttcctcccagccaaccttctgggcacctttcctctcttcccaagctctgcctgggacccttttccttcccctcagcccgtggccgtgctgtgcagccgagccccggcctggtctctggcagctcagggttcactcaggaggcgcaccatccagtcgtttccagtgtgtttgcaattatgcaacaatcgatgcaattctagaagattcttcccactccagaaagaaacccaggactctccccctcgcctggcacccacccgtctgctttctggtcactgggtttctctctgctggacgttgagcgtgagtggacccccacgacacgggtgggacgtgcttgctgtctgccctgcactgttttccaggccttccggtgcgtggtggggctgcacgcctcttcccggccgaacgccctttccatgggtgtgcacgccacaccgtctcttcatccgtttaccgacgggcacctgagctgcttccgcttctcctgccatgagtgcctgagtatgggggtcccctgaggcctccccaggtggaccatcttgccagcaccttcctcccgtgaacgggtgaagtaggcggcccccccggctcaaatccaggggtcagtgccagggatgaccctggaaatatctgctggggcgcctggttctgcggggagtgtctccagccctgcctgcaggtgccatccccgctgtgcccactctgccgcctgcccttcgaccccaagaaggtggacaaggccacccacgtggagaagcagctctcatcctacaaagcgccctgtcgaggctgcaacaaaaaggtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccgcttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcagagcttgggggcctgggcaggggcccgcttggcgggccgggcaacacgtcaacattcttttctgttcttggcattaattattgctgtcttttttt

SEQ ID NO: 1306 - DNA, 2474 bp, Homo sapiens
gtgaggaaggaggagggggagaaaaaagaatgagagcagaaaacagtcacagacaaggagggacacacagaaacacagagacaaaagagaccgagatgtagacagagtgcaaagacaggtagagaacagagagatgatagaaagtcaagcaccttatttacaaaagctagtgacagtggtactagtagtaacggcaatggcataaaggctgtgttttatttatcataaaattatgttcatgtttatgaatgtagtagaagatgaagcatttaaatacatgaatatctttgctgtttgtttgtagtatatttgacatactcactggaacatttcctgccttgccatagttaggttggtcattattcattattcataggtacaaggaatagcacatacaaaggatctaaagctacactgagcattcgtgttccaagacggagctgggactatggcatagaaggatgtggctggataggggcatacaaccaggttataaaatctcttacatgctagacgagcagagagctcatctgaaagcaatggggagccctgggagatgcataggcaggggctgaaataaaacagaagagtggggcaaacaagcgacagtagtatcatttgaatgaggagagagaaaatgctgttatgacagctgcagtctgtggacctcccttatggaaggaaacacttttcacccaccatggtgtcagaaggtagccacatagtcacaaagcctacacttgctagcttgacatccccttgatcacctgatgcctctgtacatccagccatctccccctctttataaaccttcagattcagtgacatggcacattcaccaatggactagcaggaaaagcatgtgcctccctgaatcatggattcctttgcttctaggccctggctctttcctatttctgccatggttgcctgacagacaccctgtacttaaggcagacttaagtgcttgctgtttctatccttccccacacattcctgcctcctttgcctaaaatgttccctcccccagtactgacacatagcccacctatgctcaagttccagtcaagttgccatgtaacccttcccttgtctcccaagccaaagtgactcctccctccttggaatgctccaaactaccaatttgtgtccctcatccactcttgtgatgccttaaattatagttatttgaccttcactgctaatacaagattctgccagctgctgagaatctattccaattatgagtgtctatctagtccaattatgtatgtatgtatattccaattatgcattccagaactggggagataaccacagcatgggtccaggggacccactggactcactggacccactgtgaggcagatcaagctaaaactccattgatcacctgacttccataacccctactctgactggtggaccgcagtgacgttttcttggaattaatgtctgttcagaggcagtgtccagtaatcgcagaaacacagtcacactggtaaaaggccataggtccctttgggaaaagccagaagaagggtaagctgtatacatttttggcagtgtagcaggacccttcatgaagggactctcttcattcaaggggttcctgattgcaaactgtatcaagtctgggaattgattgtttttgctatcataatgtgcaattgccttttgtttatgtgcagatatcatcatgagacccagctgtgctcctggatggttttaccacaagtccaattgctatggttacttcaggaagctgaggaactggtctgatgccgaggtaagaaacttgctgcctgcttggcctggcctttctagagcaaaggaccagccagagccccagatctcatttgattcaggatcaagtgtccttcctgggcactatgaagagaagcccctttggctggtgaaatggagagaagagggttgtgtgttcaactcattcaattctgtaagcattgctgaagcaggtgctgtatgccagaccctagatgggctacaagcacatacggatacataggaaagagcccctaccctcagcaagctcactgtcagtaaaggagacagaaatacatcaatcaaaggaggaagagaagatgaggaattcacagaaaggataatggagtttctgtacaagatttaccagaaagagagtggtgtgtagacatgcctggagcagacaccttggagccgctgacagaaggtgaagcagtccaagaaaatgtggaaacttttccgctgctctacacagtccacaaacctgtccattttatttcgttgaagctttgtctgagagataaccaaatagacagtcaaagtaagttatctcagccacatatggggagtggatgctgctgaattgtgattaattgggggagccatataggtacatttggcatgatctgggcctatgcggtcttacaatccctgtataaaactagacaatgaaaaacagaaaacaaaac

SEQ ID NO: 1307 - DNA, 2566 bp, Homo sapiens
gtgggtcgagctggggcgcagctcgcatgggggagtctatcccgctggccgccccggtcccggtggaacaggcggtgctggagacgttcttctctcacctgggtatcttctcttacgacaaggctaaggacaatgtggagaaggaacgagaggccaacaagagcgcggggggcagctggctgtcgctgctggcggccttggcgcacctggccgcggccgagaaggtctatcacagcctcacctacctggggcagaaactagggggccagtctttcttcagcaggaaggattccatccgcaccatctatacttcattgcataatgagctgaagaaggtggtgactggccgtggtgccctgggtgggactgctcctcacgtggaagaactcctttcccacctgtcagagcagctctgcttctttgttcaggctcggatggagatagcagacttctatgagaagatgtacaccctcagcacacagaagttcatcaatgctgaagagctcgttggccttttggacgccatcatgaaaaaatacagctccagatttcaccacccaatcctcagtcctttggaaagcagtttccagctggaagttgacgtcctgtgtcatctcctgaaagcccaggcccaggtctcagagtggaagttcctcccatctctggttaatttacacagtgcgcacaccaaactgcagacgtggggccagatctttgagaaacagcgggagaccaagaaacatctgtttggagggcagtctcagaaggccgtgcagcctccacaccttttcctttggctgatgaaactcaaaaacatgcttcttgccaagtttagcttttactttcatgaggctctgagccgacaaacgactgcttcagaaatgaaaacgttgacagcaaaagctaacccagacttttttggaaagatttccagcttcatcagaaaatatgatgctgccaatgtgtccttaatttttgacaacagaggttctgagagttttcagggtcatggttatcaccacccccattcctacagagaggcccccaagggtgtggaccagtatccagctgtagtgtctctgcccagcgacaggccagtcatgcactggcccaatgtcatcatgatcatgacggaccgcacatctgatctgaacagcttggagaaagtggtccacttctatgatgacaaagttcagagtacctacttcctaacccgcccggaacctcactttaccattgtcatcatttttgagtcaaagaaatctgagagagactcccactttatttccttcctcaatgaggtctcacttgcccttaagaaccccaaagtgtttgcaagtctgaaacctggatccaaaggttagcaggtgatttgcgtggaggggtttcaagactagaaactgttcttaattgccctaatgatctacggtggtctgtgaatagagtttacatccattcatgcctctttcagaactaaattaaagacaaatcctccctgtgttgcacactttataagcaattaaggccaattgaattaagtttccaaagagtaatctaggaagtggtcatgggctaccatgtgtctccatggtacagcaaagtagtttcagtactttcccctattttgctatatttcttgtagattgaatatttattgggctttttttttttcccatatgtttttctgttgttctaaacattgtgttctactgcaattccaaacagcctctctgtttccctccttcttggaagagtaatagggatgagatattaaatggcctttttagaattaagaactatatgttttctgtctcataaattagcaaatgaatatggagttagtagatttatgattctgatctacaaattaacatttttgatgccaaaattagggtcttggtaagaaatttctatcagttattgaaactgaaagtgagtcagattggtagcatgacgtaaggttttaacagttcagaagatcctcatggcagctttaatagccatgggttcttttggggtaatgtacacacctaactgcatttgttttgacttctttaatgtttgaatgtttcactctgttgtaaagtcagcataagccatcatgtgggctttcttcattcttcagcatattatccgcttcgctttctgtttatcacttttctgctgaaatgtacatgtttggctctactccttggttatttttaggcttaaaagcatgcagtcggtttttcagccacttttagatactcatgcaacatagcctacttttataaaatcaaaatgaaggtcttcatacgctgtacttgctaaaaatcaactgtgcgcttgaaagacctcttcatagttgagtaatcacctcagtacttaagcacttctgaacttgggtttcatgcctgccccccacaaattatgtttagaagcagcactgcatcttagcacatgctgccttatttctttccttcggcaggtgttcatgggaagtaggtggatcagtgaaggcataatgggctgtggagaccttcacttctagattattgattcaaaataaaaagaagccacaaagagt

SEQ ID NO: 1308 - DNA, 2417 bp, Homo sapiens
tttaagaaagcgatccagtaatataccctagctgttttccagttagagtaaattgactagatttgatgctcacattaattatgtaagagaaaccaggatatgcagaaagctcatggagctcggagtccccggctgatcaagcattaccggttctagcaagcatcagggtcacccttgggctagagaagaaagacatggcttatgagtgcactagtcagcctgggcatgagggccttggggacgggttggccacacaccacattgtctgggatgtggcagatgtcaacacagacccagcatctgtgactgtggatgtgcgagcagggggaacgttcaaggggacttgaggtgattctcttcatggagaagtggtgactaggcaatggttagaccggcaggatgcccatctcagggacgtggcggtgaaggcacagtctcagctatggtcccaggaaacagacagtggggcctccacccttccttccccgtttggattaaggggctcctggctggaacacctcacaggactggccccatctggggcccccctctgggacccacctcacacgcgtggtgcgtttgtttgtggctgctcccattcctataacctccgagaccttcactcctaggaatgtcccaaggccaattcccttggcagcaatgagaagaaatgcccttttccaaatagcgacttctgcaaaacccgctgttgtttgtgggtgagcactgcaagtcccacccatgccacagccagcctccctcctggctcctctgccagcggtggccttccccagccctcacccaggccccgactctcctctcacaggttccagcttcctggggcctggaactttccctgagtccttcccacccaccacgcccagcaccccaacccttgctgagttcaccccgggaccaccccccatctcctaccagtctgacattcccagcagcctcctgacttcagagaagtctaccgcctgcctcccaagccagatggcaccagcaggtcacctggaccccactcacaatcctgggacaccaggactacacacctccaaccttggggcccctccaggtccccagctgcaccattcaaaccctcccccagcgtcccggcagtccttgggccaagcgagcttaggacctacgggtgaactggccttcagtcctgccacaggcgtgatggggccccccagcatgtctggagccggggaggccccagaaccagctctggacctgctcccggaactgaccaaccctgatgagctactgtcctacttgggcccacccgacctccctacgaacaacaatgacgacctgctttctctgtttgagaacaactgatcctgtgtttaccccaagcccggcggggacacgctcacagatgtcaccacagccctgcccttcatgcccagccccatgggacacccggtggtctttcccaaacctcccccaaaacacacctggagccagagccttctgccgccagccctgcccctgaattggaagcagccctgtgctcgatgggaggggctcccaggccggcagcccttgccacccccctctgccaagcctgctgctgcagaacggtttttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctgtgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttggtggg

SEQ ID NO: 1309 - DNA, 2198 bp, Homo sapiens
ggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctggtacagtatgggggttgtaaattggcatggaaatttaaagcaggttcttgttggtgcacagcacaaattagttatatatggggatggtagttttttcatcttcagttgtctctgatgcagcttatacgaaataattgttgttctgttaactgaataccactctgtaattgcaaaaaaaaaaaaaagttgcagctgttttgttgacattctgaatgcttctaagtaaatacaattttttttattagtattgttgtccttttcataggtctgaaatttttcttcttgaggggaagctagtcttttgcttttgcccattttgaatcacatgaattattacagtgtttatcctttcatatagttagctaataaaaagcttttgtctacacaccctgcatatcataatgggggtaaagttaagttgagatagttttcatccataactgaacgtccaaaatcttgatcagttaagaaatttcacatagcccacttacatttacaaactgaagagtaatcaatctactcaaagcatgggattattagaatcaaacattttgaaagtctgtccttgaaggactaatagaaaagtatgttctaacctttacatgaggactctattctttaactcccattaccatgtaatggcagttatattttgcagttcccacattaaagaagacctgagaatgtatccccaaaagcgtgagcttaaaatacaagactgccatattaaattttttgttgacattagtctcagtgaagactatgaaaatgctggctatagatgtcttttcccatttatctaaatatggactgctcaggaaacgagactttccattacaagtatttttaattaattgggccagcttttcaaacaaagatgccacattcaaaatagggtatattttcctatattacggtttgcccctttataaatccaagtagataggaagaaagaagacaaactttgcatctcagtatgaattattcaatttatttgaatgatttttctttacaaaacaaactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaactaataattgcagaggtttt

SEQ ID NO: 1310 - DNA, 3484 bp, Homo sapiens
ccttgtgagggcccaaattttcctggcaagatgaaagtattgtaagtggcaattttgcctctctgcctgtgttatctccttttccttcagggcaaatggctagctccttcacccacagacacactttcagtaggtgtggtatgtgattcttttaaaatctccgtaaagagtttctgttgttggtcgcctcagcacagaatggatacatgcagaacttccattatatttatctaaccagctggaacaggtattggagggagggtgaagacacctgtggacatggccagggactgagacaatgatgctctggacaaactatccttctctgtaaaactttggctttgagaagagccatcacttgcttcaatttctttgtagtgaaattgagggaggtgttgaggacagaaacctgctcctgtcacttgactgcaagtgagcctgaccggtcactaacataaatgctcaagacccatcatgaccctgcttttggggtcttgcaggtctcagatgctgctgcagattttcttctgcttacacgttgtagaacgaaaagcagcaggttctgtgggagatgttagcaacttgtctttgaagccaaagtcccattctgaatctctgcagccctctccttcagaagattttctttttttcaaatggacaggtccctggtggtatcagtccataaaggaagtatattttgttcatcacattcaccgagaactttgaccatcttccagcccctgttaagcctggaaggtgaagaatccctatcagggacaaagatggctcaattttcttccatgttctaccccagcactccactttaatttcagctttatgttcattttagtcagcagtggcttaacagtctccagagtagatgtcagggcatctggtggagttcatacagagatcttttctttttctcttttttataacagctttattgcaatataattcacatagcatacagttcatgtttttaaatgtacaattcagtggttcttagtttattcacaaagtcatgcaaccatcaccacaatctaacttttgtcatgcctaaaataatatatatccacgcccattagcaatcactccccattctctccttccccctcagcccctggcaaccacgaatctcctttctgtctccatggctttgcatattcttgtcatttcacataaatggaataatgaaacgtggtcttttgtgactggcttctttcacttagcataatattttcaaggtttatccaagttgtagcattaatctgaacttatctttttatggctgaataatattccattgtatggatggaccacattttattcatccattcatcagtcaatggacattttggttatttctgcttttttggctcttaagagtaatgccactatactgtttgtgtacatgtttttgtgtggacttacattttcatttctcttgggtctgtacctaggagtggaattgctaggtcatgtggtaactctgtctttaatatttcgaagaactaccacacttttcatagtggctgcaccattttatgttcccgttggcaacgtatgagggttccaatttctccattttgtcaacacttatcttttttttttattatagccatcctagtgagtgtgaagtgtgatctcatggttttgatttgcgtttcttttgtggctaacgacattgatcatcttttcatgtgcctattggccatttgtttatcttctttggagaaatgtgtattcacaccctttacccacttttaattggattattaatctttttacttttgagttatgaattctttatatattttggatacaactcccttgttagatatatgagaaaattgagccctctttgtaaatattttctctcattctgtgggctgtcttttcactttctattttttatttttattttttagagacaaagtctcactctgtcacccaggctggggtgcagtagcatgatcatggctcattgtagcctcgaattcctgggctcaagtgatcctttccccctcagcctcctgagtagctggaactacaggcatgagccaccattcccagccaatttcattttattttttatagtgatggagtcttactatgttgcccagtctggtctcaaactcctggcctcaagtgatcatcctgcctcaacctctcaaagtgctgggattacaggcctgagccactgcacccagccaattatcaatattaatcagatctgtacagtggtcacagtccattctagttcagttgctcttttctagaacctatctcccagtaatggcacatatggctgtttttctaggagaacatcagttgctcttttgctctaagaattcggtgtttcttgctgtgggatgaaaggttgtagattatccctgtggtaactgcactgatttatcatcccaaccatggacggttttgaaaagtaaagagagtgctaatgtacttatgctggacagacagttttaaatggagactgtaatgggcgcagtaggatgcgtggtcactctggttatgcgtgttctgtgaatttgttgttaattgggaaatactggtattaaaacgttctgtatttttctcaagagccacagatatatgctggtccatgcacatacacgagtgcacatttatgcacacacacacatatacttaggcattcatgcctaataatacataaggtagaggtaggtagtctggctaagttaatgtagaatttttgctaaaaataatgttcttgtattattttccttcagacttgttcacaggggacacctgcaggtcttctaagtgctattaattcttacacaaaaagggcattccagttaatatggtttgtcaggaagaaatacttattaaaatgtcttggaataaatggaacacaaatgtttgaaaaggcccatttcacagcttttattcaagttataaaatgggaattacttcaggtgtaaataattcatcccaataaatttgtttcatttggtgtctatcttcctgaccgcctgtgaatatgagattttatttttggagccctgtgttgttaaccacttgttagtttaacacctctcatgaatcagagttctgaccctcaagggtccagacctctaagtcctttttcactgaagtgtttgtgcttttctataggcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtgacccccccatggttcaagtgacagtgggtgaccttgtctgccaagatctttcttttgaatgttttgaacccaactacttgtcatagatgtttgactgtgtcaaaagctgtgagcagcaaaatataatccatatgaccttttctcttgc

SEQ ID NO: 1311 - DNA, 2277 bp, Homo sapiens
ttatttaagcctcgaattctcttttaatgttttgtagtttttagtgtagacatcttatacttctattaatatatttctaaatatttttttggatgccattgtgaatggcatttattttattttctagttgtttgctgctactatatacacataaaaactgattatcttgtgacctttctaaattgatttttagttctagtagttattttgttttttttcttttgcaagcacaaatagttctacctcttttctgatctttatctctttctttttctttccttaatgtaatagttatggtctccagtacaatgttgaattgaactgatgagagtgaacaccattcttgccttgtttccaattttaagggaaaagcatttggtgtttcactattaagtatgatgttagctgtaggtattttatagatgccctttgttagttaatgaagtttccttctactctagtttgctaagaggtttgtttttttgttgttgtttttgtttttaccatgaatggatattgaattttgtcaaaggctttttctgatctagcaatccttgagaattgattccttttattttaaaaaaatatttcttagttttctggggttttagggatgaggtctcactatgttgtccaggctggactcaaattcttggcctcaagcagtcctcctgccttggccttgagtgtagctgggtctacaggtacatgccactgtgcccagcttgattctattctatacacaaaccgtactccccttcttcttcctcccaccaccattctaatatgcttaattatatctctttatgtgtttttacaaagtctgtattgtttatgaacatgtatgtttttacataactgtgtataaaaatgtctttacctatatataaaaatctttttccactgagcactatgtgtgtaagatccatctgtgttctttgggtatatctcatcaaattgttagcaactttatagcacagacagtgcaagtgctccatattgaaatactgtaaatgaggttttggaagaatgagtatagaatatgtgatcagaagtaactgcaaaactgagtcactgactgatgaaatccatggaaagaatgtggggttagaaggtggtcatgagtgcaaattctggatctgctctttactgctgtgtgatcttgggcaattaaccttttttgagccttggtttcttcttagaatgggagtgacaccttctatgattgttgtgaagattaaagataatgaagatgtaactgcctggtccctgataaactgtcacaatatgttgagacatattgtctcaacatacgtcacatatgttgagacaatatgtgagacagagtctcactctgccccccaggctggggtgcaatggtgcgatctcggctcactgcggcctctgcctcccgggttcaagccattcttctgcctcggcctcccgagtggctgggattacaggcgcctgccaccacacccagataatttttgtatttttagtagagatgggatttcaccatgtaggccaggctggtctcgaactcctgacctcaggtgatccacccgcctcagcctcccaaagtactgggattacaggcgtgagccaccacacccagccagtgtcgtttctttccttcctcagggctggctctggggggaagcgagggtcaacagtttgtgtgtggtgagcccgaaggtgccaaagcacaccccacacagaggcactcttcacgcatctcagattggagataacagtaaatgactatgcagagtgtggtgtttaatgtcaatttttccttctgtcctctgcaggacaaagtggccttggagagtatgcctctgctaggcttcaccattgctccagaaaaggaagagggcagcagtgaagtaggacctatttttcacctttaccacaagaaaaccctattttatagcttcaaagcagaagataccaattcagctcagaggtggatcgaggccatggaagatgcgagtgtgttatagcagttatcaagcatgtggacttgtaacaaattcttaggtcaatatgtgaatgcttttagaagctaagctgtggctcaactcatccggacacacacctggattcagcaatgaggcctgaccttttttgctataaccgccccaccactcccctgcccttgccaacatcttcatgaatggaatccttaagggatatttatggacctctccttttctgtgttttccacccctacccccacccgccacccagtaataaactatttccttaccccgc

SEQ ID NO: 1312 - DNA, 2285 bp, Homo sapiens
agctgtttccctctctctgagggcaactcccctggccctccctccttcggcctggttgcaattctggccggaaacccgctggtgcctgtggcaaataaagtgaggaaggcaggaacctttagacttcccagtgtgaggcaacggcagggctaggactagggtgaggctgttggtgcaagatttaaggaggcgctcactcacaggtgcggaccctgcacttacaggaccctgagagcgagtgcctccttaaatgttgcactccagggtcctcaccgtccttttcctagtcctgggctccgggttctaagcacccagatgctccttcctcaaacggaggtttccgcaagacaggactgggtctctttccttctcagccctgccctcagaattccagcccctaatcaacttttatggagatgcatgccaggccaaagggctgcccctaagctttaggaaggaaactccttaaatgctgttgacttaggagttccgccagtgccccacctgcccagagcctcttgccccagtgccccacctgggtttatggtgcccccctcccagaaatatgagctcaggggtcagaaacccaggtcctgaggtccctcctccccaaggactcaggatcccaggcccccagtcccctcttcccttaagtttaagaagtccaggccaccaccctcttggggacccagcacccaactcacgaagcgcccgaagcggatggagtctccatcctcaatgtactcaggagttctgggccccagcttcccattccactgacgctgcagcccagccccgctgggatccatgagtttggtccccggactgaccagcatagagcagccgcagccccagctccttgatcagctgggcatcccgaggcgctgtttccaggactgggtcgatcagaacggcctcccgggactctctgtcacccagcagatacggggtatcactctgttgcgcaggctggaatgcagtaacacaatcatagctcattgcagacatgaactcctgggccctccaaccctatccccatcagcctggtcatcaccggcgtcacccccgccccgcgccctgcccctaggttcctgtgccagcaagatgctggagcgaggcgcggagtccgcggccggggctaccgatcctagtcccactggcaaggaaccagtgaccaaagaagctccccaccagggcccaccgcagaagcccagccagtcagctccagggcccaccgcgtccgcgggctcgcctccccggcctcgccggcggcccccgccccagcgcccgcaccgctgccccgactgtgacaaggccttctcgtacccgtccaagctggccacgcaccgcttagcacacggaggcgcccgaccccacccatgcccagactgccccaaggccttctcctacccctccaagctggcagcccaccgcctcacgcacagcggcgcccgcccgcacccgtgcccacactgcccgaagtcctttggccaccgctccaagctggcggctcacctctggacccacgcacccacccgcccctacccgtgccccgactgccccaagtccttctgctacccttccaagctggcggcccaccgccacacgcaccacgccaccgacgcccgcccctatccttgcccgcattgccccaaggctttctcatttccctccaagctggccgcccatcgcctatgtcacgaccccccaaccgcgcccggcagccaggcgactgcctggcaccgatgctccagctgcggccaggcctttggccagagacgcttactgctccttcatcaacgcagccaccaccaggtggagcacaagggggagagagactgagccctcccttggctcactgtccccttctgccgccagccctagccagtaagaggtgggatttctaagaccgactgtatgagctcgcctcttccagatagctggcagagggcagggcaagggattggccatttatactgggctcgagctcagaagcccgaggaactctttgctcccctgctttggggagatctcaaaccatggacgtggagctgtggtttgacagcgctggctctgcttctccccacacacttacatggcaaaggtaaaaagtctgctactatcgtgggttgatgaggattgtgggcaaacaggctctcttgttaaaagtttaaactggtgtctccactttggccatatgacggtatctaagaaattgaaaatacatacatgcttgtctcaactcttccacttgtaggaatttattctataaactcatgaatgtg

SEQ ID NO: 1313 - DNA, 2101 bp, Homo sapiens
agtctgggcgtttaggtcagaactaccccggtagcctgacagcaggagctcgagagaagcatggctcagcggtgcgtttgcgtgctggccctggtggctatgctgctcctagttttccctaccgtctccagatcgatgggcccgaggagcggggagcatcaaagggcgtcgcgaatcccttctcagttcagcaaagaggaacgcgtcgcgatgaaagaggcgctgaaaggtgccatccagattccaacagtgacttttagctctgagaagtccaatactacagccctggctgagttcggaaaatacattcataaagtctttcctacagtggtcagcaccagctttatccagcatgaagtcgtggaagagtatagccacctgttcactatccaaggctcggaccccagcttgcagccctacctgctgatggctcactttgatgtggtgcctgcccctgaagaaggctgggaggtgcccccattctctgggttggagcgtgatggcgtcatctatggttggggcacactggacgacaagaactctgtgatggcattactgcaggccttggagctcctgctgatcaggaagtacatcccccgaagatctttcttcatttctctgggccatgatgaggagtcatcagggacaggggctcagaggatctcagccctgctacagtcaaggggcgtccagctagccttcattgtggacgaggggggcttcatcttggatgatttcattcctaacttcaagaagcccatcgccttgattgcagtctcagagaagggttccatgaacctcatgctgcaagtaaacatgacttcaggccactcttcagctcctccaaaggagacaagcattggcatccttgcagctgctgtcagccgattggagcagacaccaatgcctatcatatttggaagcgggacagtggtgactgtattgcagcaactggcaaatgaggtttatggagagaaatcccttaaccaatgcaataatcaggaccaccacggcactcaccatattcaaagcaggggtcaagttcaatgtcatccccccagtggcccaggccacagtcaacttccggattcaccctggacagacagtccaagaggtcctagaactcacgaagaacattgtggctgataacagagtccagttccatgtgttgagtgcctttgaccccctccccgtcagcccttctgatgacaaggccttgggctaccagctgctccgccagaccgtacagtccgtcttcccggaagtcaatattactgccccagttacttctattggcaacacagacagccgattctttacaaacctcaccactggcatctacaggttctaccccatctacatacagcctgaagacttcaaacgcatccatggagtcaacgagaaaatctcagtccaagcctatgagacccaagtgaaattcatctttgagttgattcagaatgctgacacagaccaggagccagtttctcacctgcacaaactgtgaggtcaaggggcctgctgggttaggcatgcccgaccccgggacaggactaacccaagggggaaagctagtgttgatgaaacttttgatcaaaaccacattgtaaaacattgcccatctgtcttgctcactcttaaactctcccaagaacaaggccggggtaaggtaaagtcagcagaaatctggcttctcccttcctcccgacatctgcatcccttgatccactggcatttgctgccctcttgtcccttatctgtcttatgctggttatttcactgcttcaccttccaggcttgacttaacaaatgtagatttgagaaatctcaaccagttgttacctgataggagtctttaatttagggcactcttgctgggatgctttctccagagcttatatatttcttcttactagaactttcttcccccttttattcccctctcttcttggactcatgagctgtctcttcatctctcctctctctcctgcatctctccccttactcttcaatttattctacttctggacctggacttacccaaactgtgatactaccataattgtcaccataatcagtcaaataaagtgatctgtgcatc

SEQ ID NO: 1314 - DNA, 2059 bp, Homo sapiens
agaagaggccccaagacgcatacgggacgtcatcaatgtgtttcaccgccttcgacagctgagagacaaaaaaccctgtgctctctctctggcaggaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatgggtagcctctgagggtaagtgactaagacttctcctctgctgtccaagcgctttggtgcagggacagcggcatcttcagccaatccagtgcaggctctccaccgaaggctggctctagactggtggaattacatgaacgacagccctcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagaggcaaaggcccaagcccggggcctgttgcctgggggcacacaggtgctggatggtacctcggggttctctcctgcccccaagctggtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatttgtgcggtgctgagtgcaggccaccagctcctaaatagaggttccctatatgcgcgtatgacatggtgaataaacacaactctctccactcaggacatccggagcgtt

SEQ ID NO: 1315 - DNA, 2117 bp, Homo sapiens
gatatttcagtatacattgtgaaataatcacaagctaattaccatatctgtcacctcacacaggtggctgttgtttggtgagaacacttaagatgcaccccagtacttttccagcacgcagtgcagtcttcttccccagaggcccctcggccattaggttctaagcccgagaagggtcctgtgcacctgccaggcggccctgaccctcaggcggcagaggccctgtccaggaaggacatagatttggaggcacacgcgtcaattctgggtagccgggcaaagccctggtgctcttgggaggggcttctttccctgctgacccctcccgtttctccctggcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagcatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaacactg

SEQ ID NO: 1316 - DNA, 2128 bp, Homo sapiens
acttcctttccgtatcaacaggaggccagggactggctggacccctaggagccaggtcctacggataggtgagccggccccccagggcaaacacctccactgggcagacctgactgcccagagctggattctttacttgtaaaaggggccatgagtgacacaggctcggcctgctgtgccttgaggaaaggagaggctaaaaattctgccttctctcctaaagccagccgggctctttatggtgggggaaggaaggatttgtttatttgcactcttctgaaataaaagttctctatcctccctcctggctggagttgggagggccccatgggtgggctctgagatgtggcacacggtacccagggcagggctgggaagggtggggtgcaggggcctccctggctgcagggcccacccaccaggtgcctgggcttgctgcactgagcaggcatgggctctggcccccctcactgtcccttccaggcccagcctgtgttcagggcccaggacagggtctggccagcaggccccaggcctccaagatgttctcagcctctggagtgtgtgtgatgatgagcactcatggagcttcctgtatgctgggccctgggcttctgagagggccaccgggtggcgactgagtcacgaggtggagggccagtcccagggactccaggcgacctcgtgtcggcaccacgcccttctcccatgggcagtcctgggcgccccttcctggccttgggcccagtggcctgtggcctgaccccgtccactcctgcttggttgtcccagcagcagcaggagcccatgctggagaaggtgttatggggcaggtggagggcccggctgactcagatgatcccccaagtttcttttcaatgaacacttgtttagtgcagtttttcctcctcaaatccccctcacacaggcagacaccctcttggcccagggtaatctgctgagcctttgctcaaatatagcagctttgctgctttctaaacacaactaatccaatttgggatttggggattcgaggtgggcagcactgggcctcagatgagcccccatcaccccagacccatgcaggaagagccaggcagggtggggccctggggccacctggtgggctcagggccagggcatcgcgatgtccccatccttcacactacggggcttcctggctgcagagttggggactcagctgggaatgctggccatagaggcagagagcccccatcctgctgggccagccctgacctggcttctccagggtggcccagtgtccccttctgcccttcccctggctcccaccgtccacatccctctatctgcccaccctggacaacaaccagcacagtgcagtgtggccctgcagtgacaccacctgcagagaggtcaggcccagcctcccccgtctcctaaaaggccagcaggtcccaggagctgggggtggggcctggctgtggggcctccatgccccaggggccagggcagaccctccttagccggcaaccactgcagattcctcccctggccagcactcggggacctccctgcccctgccccgtccccctaccttgcctgctgagacatagggctccacgggtctctctcctggggccgggctgactgtggcctgcgaggggcagtcatcgtgttgggttttcctgccagaggcagaaaccacaaaattacctggaacatacacgccccaagtgacagattcaattcaattccacaaatattgacctcgcgtctaatccactcgtcctccagtgccagctcattcctgagaagcccagcctggcagccgcagatcccatttaatcccagccccacaatgtcaccagctcgcagcttgggagctgggctcatccaggccctggcaggtggggccagagctgggctctgacctctgtacccacacttaccaccatgtaaagtgctgggaagaggggtggggagtcacggcaagttgagggtccaggcttgccccagctcgccagatgctcgccctggctgccctgacctagcagctaatctctgcggggcactgcggctacatggtgactccagtacggggacatttatcagaaatggaactgatggattaaagtggaaccaagcg

SEQ ID NO: 1317 - DNA, 3316 bp, Homo sapiens
cagatttactgcagtggcggcggcggcggcaccggcaccttgcagtatcactggggagacggcggctgtatagcgcttgccgccccacggattatcccagcaggatctacgcaccccgcatcctccgtagttccgccctatccttgtcctccttggctggggcgcccaccggcggtctgataggctacatcgcggcatgagatgaagctgtgacaggtttgaaaacacaaacacaatggcaggaaacagccttgttctacccattgttctttggggtcgaaaagcgcccacacattgcatctcagcggtacttttaacagatgatggggccacgatcgtaacaggatgtcacgacggacaaatatgtctctgggatctttcagtagaactgcaaattaatcctcgagcactgttgtttggtcatacagcatcaatcacttgtttgtctaaagcttgtgcttccagtgacaaacagtatattgtgagtgcatctgaaagtggagagatgtgcctctgggatgtgagtgatggcagatgtattgaatttacaaaattagcttgcacacatactggcatacagttctaccagttctctgttgggaatcagcgagaaggaaggcttttatgccacggacattaccctgaaatccttgttgtggatgctaccagccttgaagtattatactccttagtatcaaagatatcaccagactggattagctccatgagtattattcgatcccaccgaacacaagaggacacagtggtagcactctcggtgactggcatcctgaaggtctggattgttacctcggaaataagtgacatgcaggatactgagccaatatttgaggaggaatccaaaccaatttattgtcagaattgccaaagcatctctttttgtgcatttacacaaaggtcacttttggttgtgtgttccaaatattggagggtgttcgatgccggagactattccttgttgtgttcaggtcctagtgaaaatggacagacatggaccgggggggactttgtctcatcagataaagtcatcatttggacagaaaatgggcaaagttatatttacaaactacctgccagttgccttccagctagtgattcattccgcagtgatgtggggaaggcagttgaaaatttaattcctcctgtacaacatatcctcttggatcgaaaagataaagagttgctaatttgtcctcctgttactcggtcttctatggatgcagagaatatttccataaactgttaattcagggtgattcttctggaaggttgaatatttggaacatatcagacacagctgataaacagggaagtgaagaagggctggcaatgacaacttctattagtttgcaagaggcatttgataaactgaatccttgtcctgctggaattatagatcagctgagtgtgattcccaatagtaatgaacctcttaaagtaactgcaagtgtgtacataccagcacatggacgacttgtttgtggtcgtgaagatggaagcatagtaattgtacctgccacacagacggccatagtacagctgttgcaaggggaacacatgctcagaagaggttggccacctcacagaacactccgtggtcatcggaacaaagtcacatgtttgctatatcctcatcaggtctcagctcggcaagagtacagcactgcatctgctctgtagccagtgaccactcagtaggacttctaagtttgcgagagaaaaaatgcataatgttggcatctcgtcacctttttcctattcaagtaatcaaatggaggccttctgatgattacctggtggtggggtgttcagatggttctgtgtacgtctggcaaatggatactggtgcattggatcgttgtgtgatggggataacagcagttgagattctaaacgcttgtgatgaagctgttcctgctgctgttgattcacttagtcatccagcagtcaacctaaaacaagctatgacgagacgtagtcttgctgctcttaaaaatatggcccatcataagctacaaacccttgcaactaacctcttggcttctgaggcatctgacaagggaaatttacctaaatattctcataactccctgatggttcaagcaataaagacaaacctaacagacccggacatacatgtgctattctttgatgtggaagcgttgattattcaactcctgactgaagaagcctctaggccgaatactgctcttatttccccagagaatttgcaaaaagcatctggcagttcagacaaagggggctcttttttaactggaaaacgagcagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggccacctagaccaagcaccccagacctttctaaggcaaggggttcccctccaacttccagtaatattgtgcaaggacagattaaacaaggttggagtcagttagctgctatgcactgtgttatgctgccagacctactgggattggataaatttaggcctccccttctggagatgctggcccgaagatggcaagatcgatgcttggaggtgagagaagccgcacaggccctgcttctggcggaactgagaagaattgagcaggcaggcaggaaggaagccattgatgcctgggctccttacttacctcagtacatagaccacgtcatatcacctggagtcacatcagaagccgcgcagactatcaccacggctcctgatgcctcagggcctgaagcaaaagtccaggaggaagagcatgaccttgttgacgatgacatcaccactggttgcttatcaagtgtccc

SEQ ID NO: 1318 - DNA, 2155 bp, Homo sapiens
aatgcctctcaccagctgtgcctgagctgcagcactccagccactgctgtctccttagctgctcacatatggatactttcacagttcaggattccactgcaatgagctggtggaggaataatttctggatcatcttagctgtggccatcatcgttgtctctgtgggcctgggcctcatcctgtactgtgtctgcaagaaatgggaaattgccaagcccctgaaacacaagcaagtagatgaagaaaagatgtatgagaatgttcttaatgagtcgccagttcaattaccgcctctgccaccgaggaattggccttctctagaagactcttatggagtcttgctctgtcacccaggctggagtgcaatggcacgatctcggctcactgcaagctccgcctcccgggttcatgccattctcctacctcagcctccggagtagctgggactacaggcacccgccaccacgcccagctaattttttgtatttttagtagagaaggagtttcaccgcgttagccaggatggtctcgatctcctgacctcgtgatccaccggcctcggcctcccaaagtgctgggattacaagcgtgagccacttttttttgtttttgagatggagtctcgctctgtcccccaggctggagtgcagtggcgcgatctccactcactgcaagctccgcctcccaggttcacaccattctcccacctcagcctcctgagtggctgggactacgggtgcccaccaccacgcctggctaattttttgtatttttagtagagacggggtttcgccatgttggccaggatggtctaaatttcctgacctcatgatctgtccacctcggcctcccgaagtgctgggattacaggtgtgagacaccacgcccgtcccctatgaaggtgtcttagatagctcaggctgctgtaacaaaaataccatagactggggtgcttgcacaacagaaatttgttttctcgttgttctgaagctggaagcccgagatgagggtgttggccgatttctgtgaggtttctggtgagggttctcctcctggcttgcagacagctgccttcttgctatgtccccacaaatggcctttccttggtgcattcaagctggggaagagcatcagggagtcagatttctggtgtttcttcttacaaggacactgatcctgttggatcaaggcctcatccctatggccacatatagcctcactgggggttaaggcttgaacacctgaattttggggggacacaaacattcagtctgtaacactaggatttatagatgcagcatcctgattattttatttttgaggcagagtcttggtttctcacccaggctggagtgcagtggcatgatttcagctcactgcaatctccacttcctaggtccaagctattttcctgcctcagcctcctgagtaactgggattatgggcgtgcaccaccacactcagctaattttttgtatgtttagtagagacggggtttcaccatgttgaccaggctcgtcttgaactcctgacctcaagtgatccacccgcctcgacctcccaaggtgctgggattacaggcatgagccaccacacacagccagcatcctgtttaaaagagatagccagaggccaggcacagtggcatatgcttgtgataccaacactttggagggccggggcgggctgatgacttgagctcaggagtctgagaacagcctgggcaacatggcgaaatcctatctttacaaaaattagccggcgtgatggtgcacacttatggtcccggctacttggagggctgaggtggggggatcgcttgagcctgggaggtctgcagtgagccacgatagcatcactgcacctggacgacagagtgagaccctgtctcaaaaaaaaaaaaaaaggggatggaaaagcaaaaagggggcagcataagtaccgacgcacccaatagcctgatataagggtgtaaattcatgttcaaatcccagcttggaacataaacagaaagaaacatggggtgtcactaggcctttcacttcctatcagaaaaactctgcctggttcctttgactggaatgttcttccttaagctctttgcctcgctggattttcctcatccttcagatgtcagctcagaagttaccacctc

SEQ ID NO: 1319 - DNA, 2086 bp, Homo sapiens
attatgcccggctaattttattttgtttgtttttttgagagagtcttgctctgtcgcccaggctggagtgcagtggtgcgatcttggctcactgcaagctccgcctcccaagttcatgccattctcctgtctcaacctcccgagtagctgggaccacaggcgcccgtcaccacaccaggctaattttttgtacttttagtagagatggggtttcaccgtgttagccagtatggtcttgatatcctgacctcgtgatccgcctgcctcggcctcctaaattgctgggattacaggcgtgagccaccacgcctggcctaatttttgtatttttagtagagatggggtttcaccatgttgggcaggctggtcttgaactattgacctcaagtgatgagcctgcctcagcctcccaaagtgctgcgattacaggcgtgagccactgtgaccttgtgtgcacgatctgctttttctcgttggcagcttttcaagctctctttgttcactgtgttaggggttccatgtgcttggccttgatgggggtcttggttctttgtgctggatacttggttctactaagaaaatatacctttggtgatttttttctctctcctttcttatgtttcttttttggtgtgcccatgagcctgtcctgatgtcttgtggagtgaccctctaattatgttctccaaattttcttttcgatgttttgttttatttttgggagatgttctcatttaccagccagtctactgaatttccaccctcagtgttttgtcttttgtttgctgtttcccgtgtgcctctcgccaggggctttccgtgggtggctggtcatcctgggctgggcaccaggtgcagagtgaggcccgggagccctggacagtgagccctgcaggccgagtcatggctgcgtttctcgagggcttcctcctgatgggggattttcagttccctgccaggggacaccatcctggctgccaggaccttgtgggtgttccagatgtggagaggaaccttgggtcctggtcactgcagacttgttccccctgagccactcacagggtgggggtcctgcagcttccctggcccccaccttggagaggtccagtgcaactccttggccctgctgtccggcctgtggcggctccaccccgggaagtgggtgttgggtcttctctatcccatcctcttttgtctgacccgttctcttgtctctctctggagcctaaagtctgttgtccactctgttcttgtcttggtaccctccataccctcgtttccccacagctgctcctcagtctctggctggcttctcctttgaagcccacgcagccagacggtgtcgaggtgacaagggggtgggtgtggctctctgggtggacgacatctctctcctgtcctttctcctccctgcagaagatctcaggcgagtgaggctgcttgtgcctcgcttgtctgtgccttccttgtccgtggtggggaacctgcccagggccacagggacggtgagccttggggacggccccacctgagggtcctgagttgccgagcacaggtgtccgtcgcgccccccaggcccaggcctgctctgccggtcagtgcggtgccaggcacgcccggcaccctgacccccgccctgcttcacccaggttggccgactgcgatgtgagtgacagcagctgcagcagcctcgccgcaaccctgttggccaaccacagcctgcgtgagctggacctcagcaacaactgcctgggggacgccggcatcctgcagctggtggagagcgtccggcagccgggctgcctcctggagcagctggtcctgtacgacatttactggtctgaggagatggaggaccggctgcaggccctggagaaggacaagccatccctgagggtcatctcctgaggctcttcctgctgctgctctccctggacgaccggcctcgaggcaaccctggggcccaccagcccctgccatgctctcaccctgcatatcctaggtttgaagagaaacgctcagatccgcttatttctgccagtatattttggacactttataatcattaaagcactttcttggcagg

SEQ ID NO: 1320 - DNA, 2366 bp, Homo sapiens
agcggcgccactgagagggacgggcgccggccatggagcgcacagcaggcaaagagctggccctggcaccgctgcaggactggggtgaagagaccgaggacggcgcggtgtacagtgtctccctgcggcggcagcgcagtcagcgcaggagcccggcggagggccccgggggcagccaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggagatcaagaagacagcggtacaagatctgagcttcaacaagaacctgagggctgtggtgtcagtgctgggctcctggctgcaggaccaccctcaggatttccgagaccaccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacagttgtttctggccaggtgttgtggcacatgcctatagtcccagctacttaggatgctgagatgggaggatctcttgactccgggaaatcaaagctgccgtgagctgtgagcatgcccctgcgctccaggcgatagagctgggggaaggaggaatagttgtttcttcaaattgaaatccaaagatctactcaaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggccgtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcccgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaggcccccagcgtggtccggcgagccttgcagaagcacaatgtgccccagccctgggcctgtgactatcagctctttcaagtccttcctggggaccggggctgggaagagatgctgatttctgcgataaaatcagtaggtacattttttggaatgttcgctatgtgccaggctagattttacagatgagaagtctgaagctcaggtaaggtaagtcacctgtccagggccac

SEQ ID NO: 1321 - DNA, 2178 bp, Homo sapiens
ctgcctctctccaccccaccccaatttcctagaaagccttgcactattcagctcccttagtgctttctgtcccttcccgaacaatatgcagtagctttaagccattcaagctccattatgcagtatatctgagaagggaaaggaaacaacccatttaaatttgaataaaaccgtgcctatgcgaacagtagcaatttagaatctcttttctgcttttaaaataatttatatttaaaaattgcactttagctttttgatctctttgtatttctcttattctctttctaacctcttctctgtcctcaaacttgcctttgctctcctttacaataccccccacccctcctccaaggctctgagcggcatcatttaaaatactttactttacagatatttgcaccaggtacatttatgtgcgtccattggtagcacagctgagacctgtgtctcacatcagcctaggtgaagcctactacaagaatgccaaggagaagggccagtacactatatggtttatactctttatccctttattcatagcatgttttttaaaaatgttatattatgcaacagatgtgaggcagcagctaagctatacttaagaattttctctcaccttccaaaccaaagtgtcctgaataagccaggagacttattcttttgtgcaccctggtgcacatctgactgttgtcctagccatagactctctgaggccactgaaagaacagtggccctatcgatttcattcctaggtctcaaaaatacaatgttgccttgtaacataattagggacagcacctctatttcacaattataatctaaggtaggataagacgacacagcagcaataaacttacaagtaaaattcaataccaaaacaaacacaaagaaatttaaaaaacaaaaaacctagctcatcatgttgtgaaaatgaaaaagtgaatgtccattcaaaatattttactatttcttgtggagtttttcagtgatgtaatgcttgtagccaaattgcttaaagagtgtttatatatttttttccttataaattgtctattttttaaaaaagctatttaaccacagctgaagtggggggtaaggccaaattgccaacacttgttaaaagattaatactcttaagtggcactctgatacctttccaacttgtcatcagaaaggaatcaataattaccaactgttgtatttagaccaacttacaatatctagctcattagaagccaggatctagaaagctccttctaagccatttaagatattcttacattgagcttcatattatagaactttataggattggatattttacaatagaataatttagcctcaggactgagaatgtggaagctgaataaattagctttaaatacatcattaaaatcttatgcacaataagctcattagattctagttttctcctttagaataccaatgccacagacactacaggagataatgaaaggtatcagttgtgttgagtggagggagtttaagagaaaggacccttcccaaccagcagccagtagaaaatacaacctactcacctttttcccttctaagttctgctaaatcacatctgcctcatagagaaaggaatgttgcctttgagaactgtcttggagaacagataagcttgaaatgttctctctagagaggacatagggtttgggatcctctgaaaaggcccagaaaaatagctcagttcaaatacaatgttctaggacaattggaatataaatattgtccaaaaatataattaaaagaaaaaagtttagcactgtgtaaagtaagtgttaactgaggaagtcccaaaaaggtgctgtcactttaagttctggacttggggttctttgtatttgtaaacagcaaagcatttgtgtttgtttgtctatttgtaaagcaaccaccttccttattggaaggagaaaaaaaggggtacatacatgtaaatacttgctgcagcatttaatatgtttaattttgtgttaagctttttgttgcatcgtgaacacatttattgttaccaatggacaatgagttcattaagactgttcaactaggtcagatttttacatctctttctagcaagaagagacaagattttgtgcatttgtacaaatgttaatatcactgcaattccaatataataaagcactcaaatgc

SEQ ID NO: 1322 - DNA, 2846 bp, Homo sapiens
ttttgtatttttttgtggagaggaggtttcaccatgttgcccaggctagtctctaactagtctcaaacgacccacccgccttggcctcccaaagtgctgggattacaggtgtgaggcaccacgcctgtccttaggagagtatttttcttttcttttcttttcttttttttttgagatggagtctcgctctgtcgcctaggctggagtgcagtggcgcgatctcggctcactgcaagctccacctccagggttcacgccattctcctgcctcagcctctcaagtagctgggactgcgggtgtctgccaccatgcctggctaattttttgtatttttagtagagacggggtttcactgtgttagccaagatgttctccatctaggagagtatttttcataggcttcagttggggaagaaaaaagccataaataaaaagactgatgcatttaactacatcaaaatggaaaaacttcagtatatagaaagacaacacagacaagattaaaacaagctacagactaggagaaaatatttacaacatataaaacagagaaacaagtactatctatactaaatacagcccttctgcaaaatcagtaagataaaggtaatatcttttgtgccaggaaaacaggcaaagcatgtgaacaggcaatttacagagctacaagtaaccaataaacatgtgaacagaggcacaacctcactacttaacagagaaatgtaatctgcaacattgttataccacttatcagttatccaattgtcaaaatttgcaaagataatttttgcagcattgttttttattgcttaaaattaaagaaaacctaaatgtccatcagtagaggaatggctaaataaaccatactatagccacactatggaatacaatacaacagttaaaaggatcaacatttattgacaagaaaagagccccaagacatattgtagaatgaaaatatcaagttgtgaaacatatgtaccatttgataccctctaacaatatttctataggtacatatatatgcatgaaactcatagaaaaaggtctggcatgatacacaccaaactaataaagtggctttctctggagagggaattaaggtatattgaagtataatttatatacaatatatcacacacatcttaaatgttcaatttgaagagttctaacaatcatataatcccatgttaccaccacacaaaacaagatgtagaatgttttcatcatcccgaaaggtcctttgtgcctgtttctagtcaatttgaggtagaaggtgggactctactccaggggtggagctcagacaccagaccaaattgaggactagctaaaatagggactgggctgaagcaggtttccataagacatgcccacccaccagtgcaccatgtcaatttaccatggccatggcaacacctggaagttaccaccccttttctagaaatttctgaataacctgtcccttaatttgcgtataattaaaagtgggtataggtatggctgcagaactgccccagagctgctactctgggcacactgcctatgggttagccctgttccgcaagtgttctgctgctgctgtacactgccacatcaataaaagttgctgtctaatgtcacctgctggcccttgaattcttttctgggagaagccaagaactctcctgggctaagcctcaattttggggcttgcctgcccagtgtcagattcccctctattcccctgaacaccactttctgatttttatcaccacggattagtttcgtttgtttttacgtttcacgtaatggaatcctgcaatactcttttgtgtctggctctgttcactcagcatactggcttttttttttttaacttctcctttttgagacagagtctcaccctgtcatccaggctggagtgcagtggcgcaatctgggctcactgcaaccttcaccccctgggttcgggtgattcttatgcctcagcctcccaattagctgggattacaggtgtgcgccaccacacccagctaatttttgtaattttattaatagtagagatggggtatcaccacattggccaggctggtctcaaactcctgagctcaagcaatctgcctgcctcagcctcccaaagtgctgggattataggtgtgagctgccgtgctgggccagcgtactgtttttgagatttattcatgttgttgcatatatcagtactttaatactttttattgctgaatagtattctactgtatataggtacaacaatttatttatccattctcttattgtttctgagtttcagctattatgaataaagctgatataaacattcatgtacaggtctttgtgtgggcatgttttcatttttcttggttaaataatactcagaagtgaacttgttgggttgtatggtaagcgaatgttgaactttataagaacctgagaaagatttctccaaagtggctgtaccattttacacccctgatgataatatattagtattctggtttctccatgttctcaccaacatttggtgctgttagtcttttgatttcagccattctagtggaagtgtggtggaatgtcattgtgttttctatttgcatttctctgattactgaagatgttgaggactagatatctaccattgcaaagcatccattcaagtttgtgcccccttttacaatggatttttctttttattgttgatttgtaggagttctttatatattctggatgtaagtcctttgtcagctacatgtactatatgtatatttttccaagcctgtacattacctatccattttgttaataatgtctatggatgaacaaaacataaattttgataaagccc

SEQ ID NO: 1323 - DNA, 2096 bp, Homo sapiens
acttggacctgatgcaaggaaacaacctccagccaccttcccccaggcctttagagtgctggtctttgcacagagaagcaccacagaggacagaagcctccaggactcacccttccccatttctggccctaccaggcagccacagaacagccaaccaggcgcaggtggttcctggtctcgtgcaccaccctcaagagaacacacagagacttagaattagagcaggactcagcccattccccagggctcgcctagctgccatcggatccacacatggacacaggtgggtcccgggtatttgcctccctcgctgcctctgccctgccagctgtgccctccacgcttgcccgccccactgcaataatgcagaagcacacagctggctgaggctgggaggcccccttcagagccgtagtgtggagcaccaacaacatgcatgtggctggggctgggtgacgcatgccacctatggtgagcgtggcaccagtcaggctgcagagaggcagaggatagcccacaccagggctctcagtgtggggaactgcccacgctctcatttccagtgtgaattctcttctatctctaagtggagtgaaggaacaggaacattttccccaaggcccagagctgttaaatcaggggttggagctcagccctcgccacacattagaatcacctggagaagctgtactacactgacatccaagccctgctccagagcaattacaccagaatgtgtggtgggttggagtagaagaagcaggcattggtattctgatatgaggacgggtgagtgccaaggtctcagccccataacaaggtgaggtcctacaggcctcagaatgtggtagcacgtgggaaattgtcctctcttctcaggaggggccagtgttcacacaggcaggggatggagagtgggcctgatctgagaaggcggaacccaaaactcctgaaggggacagtgtgacagaaggttctacttaagggccactgccactgtccttatcccaggggcacctagtgttctcctaaaggagacttctcaatataaccaggtggaacggtagaaagaatccagatttgatttgattttacccctcaaaagccctgaagaatctagattgtagaggcaggcagagccacatacgagtcttgggtctgccacttactagccatgtgatgtgcagaggagacctgttctcagagcctcagtttcctcacctaggaaatagggtgatgatatctactgtatagggcaggtgttgtaggagtaaataagctgagctacagaaatctcccagccaactgcctggtccacccagggacagaaaaccactcctctgctcacaccccttcactcactcctccctctgcctcagggctccacaaagccctgggtcctctgaagcctagaagggccaggccaggccctgggctccaggagctcaggaggggctgttacctcatcctcttgccgtgtgtgactaaggacgcttgatacttctgcacgcactcctcctggaacacctgcaggagtcttttggctaaatgactgaaattcaccctagaacgacagagaaccaaggtgcagatgagctgccagaaccactatgcacaagcccaccatccctcagtctccgtcagtctccgccaccaccttgtcgtaagtgcccaagccctgcgtccacagcagggctatgtctctgggaaaggaggaaggacggtcacacacttggattgtgaaggttgcagtggccagcaaagcccacatcaacagggagacgtgggagacacacagggggtcctcagggaacacacatgtgctcaagcttagtcctcaggaaagggaagggaaagtgaggcagccgtggaaagaaggtgtgtgagtgcgtgtgtgtgtgagacaaaaaggggtcggggtgcttgtagaactgggggagtgagttcccagataaccattaaatcagggagggcctcctggacgtgagtgtgtccgggaaacatgggagacagaggagcggggggaggcagggaaggttcaggcagagggcagaagcaggaagtggtaagtggtgcatcagtgaggacaactagag

SEQ ID NO: 1324 - DNA, 2106 bp, Homo sapiens
ctcagctgcacctgcatagtcagggggtcccttggccaggactgttggcagcaggggtcagattttcctcatggcctctccagcaggccagcccgggtttctcctggtggctgggagccaggagagcggctcccatgcagagtgctggtttcacatttgtgggtggcccatccgttgaggccagtcacgtggccaggcccaggaccagatgggagaggaccgcacaagtgcagcgtgagctgtgggaggtgtggctgaccacgcttagagagtgtggtgccaggaaagatctgatgtgtcaccattctatatctgtgatgggcagacgcaggcaggtcaaaggggccctggggacttaccgagcccctgcctattggccaggcactgtgattgtcctcggtgccatgtgccatggaagccctctcagaggtcgaggggaggcaggtggagacagagcctctgtaggcctttcaagctgtagccccagagcccagaggcagccgaattcatgtgtgcagtcagagagcacttagtgggcactgtagtcaatcagtgagcgcttactggacaccacaggcagcaagcatttactgagtacctctggcagttgatgcatacttcctgagtacctgttcatagcaggcttagctctggatgtggggtggtgaggaatcccacaggctgagaggtggcctgggagctttccagggggcctgaagcaggaggggctgcctgagtgggtcagcagcccagcccagtgccctacgcagccctgcccacacccccaacccagcctctgtctccccagtcccgtcccccacaccctggtccctcctactttgtgcctcgaggacactgccccgctgccctcctcacttcccagcgtctgctgtcccctccgctgctgctgcccggcaggattgctctgtgtctcatccacgtttgtccctgcagagttcctcgcctctccccggaaccgccagcctcatgccgcatctcagaggctttttttttctctcttttttttttttttgagatggagtctcgctctgtcgcccaggctggagtgcggtggtgcgatctcggttcggtgtaacctctgcctgtcaggttcaagcgattatcccgcttcggcctcccgagtaggtgggactgcaggtgcctgccacctcgcccggctaatttttgtatttttagtagagttggaatttcagcatgttggtcagtcaggtctcgaactcccgacctcaggtgatctgcccgcctcggcctcccaaagtcctgggattataggcatgagccactgcgcccggcctcagaggctttcattcccacttttcccccaaaactgcgcctctttggggtcatcagtgaccttcgcagggtcaagtcatccccctctcctgtcccaggaccttaagcactgccctgttttacagaagaggaaactgaggccccgagaggtaaggcagccagctcagggtcatcgcccacgcccagaaatgccaggattcccacccggacctctgaccaccaagctccaccttagtctggcccggggtcatccctcaggtgctgcctcatgccttgggtctgtctctcagaccaccctggcccttgcccctgctccccagcctgactgaagctgggccaggcagagactgaagactgaacgagtgtggccagcattcctcctgcacctgcccggagcctccaggcccagccgtccatgttcccagaagtccagaagtggctttgctgctcctggactctcactggccccccatcgacccttggaccaataactgccatcaaaataatcctgattatgcacctatcaagtccctggccctgggctaaagtcttcacaggggtcatctcatttcatcctcagccccaaaaggcaggtctcacccccaaatacatatggacaaaaagaggctctgccaggtgtgatggcgggcgcctgtgatcccagctgctcgggaggttggggcatgggaatcgcttgagcccaggaggcagaggttccagtgagccgagatggcgccactgcactccggtctgcgcgacagagcgagacttcgcacccgccgcccccccacc

SEQ ID NO: 1325 - DNA, 2859 bp, Homo sapiens
ccaggttcctgctgcacagcctgcccaaggacaccccctcgggcatctctaaagtgtatcctttctcttatccctcctccgtcccaccaccgttcttgtctaatggccccaagaaattccttccagagcactttcctggcagaaccttcctctctcagcaaccctcagggaagacagagaactcaccctcccgctgctgtttggctatagaggctcagcagggaggcccaggggcccaggccaagagaagatgagttttcagggctctctgagctgaacccagcagtgggtctctggccaacacactgtcccaatccctcctagaacccacagatgagggtgtgactgaaatggaagaagcaccaggccttcaggcttggaaccttgggcacttctccagactggggaggagggagtgtttgttcagcccaggtatacatagcaccttctgtgccccaagccctgggccaggcaccaggtggcaaagctgccatcaaagagggaggtcacaagttagggtctggtttggtggatgtgtgctgtgtctgagggtggaatgaagctgaggtcagggccatggtcagggaagtttacctggaggaggagatgtccatcatgcaagctgaggcagccagggaagatggccaagtggatgttccaggggaggacccagcatatggagaggcaagcaaggcatgtgggagagggtgaggggaccctgggtgggaggggccggagaggcagcaggacccaaggcctgagagcctacctttgggttttcctctcttctgtagccatcgagggccacagtggtaccataagcagagcaggtgcctgaagggcctgtgcagccagatactggatcattaccaggcaatgatccagatttttaaggtcttggatgtcaggagacataattgtccctgttcttttctaaatctcactgtactctcagctccttcccagccgcagccccaccttccctctgtaaggaaaacccactccactggagaagacccagagctccttgttgtaagaattggcctcgctagaggattccaggcccattatgtacatttcaggggaaataccctcaaatcaaggggtgccttcctggagtcagacctctgctgcatgcgtctccgtctttccccgtaggagcagtcagggctatgcctgtgggggctgagcacctgtactcatcctttccagcaagttctgtttgagtcaacagcttgatagaacctctaccctgagccttaccctgtgccatcccctggggacctggaaatggctcctgacagtccctgactttgaggagtcatgctggagacacagaaggaaactctccacagaactgctgaagtggacggggctgcactgcagacggcgggagcaggaacactgggagagatgcgggaggaagggcaggagggcctgggggcagccaacatcggaggtgacctgagaggagagcacaaaggctcgtcagcctctggctgaggagcttcaagggggccccagagcacaggcgaggctgccgctcagaaactgcccaccaggccctcggggaagggtgtgcagacagagtggggtacacccaggggcctcagagcagggttgagggtggctccccagggagtctggaccaggccccacctggcagggtgagagcagagtgccctttgtgccaggcatcctaggagggcctggctggcaggtttggtgaggcaggaagagccattttggcctagtcagggtataagatgagccatcagcaggcccagagatgctaagcaaggttaaagtattaatggaaactacgctgtttttatctttgaaaaaattcctgggccttgccatccgagaagtacactcacctctcacaagcgcacagagccttcctcacggtctttcctctgccttcccggcaccagcacaagctgtgttccagcctggggctcactccaaggacaggcagtgccagctcctgggcctggtgttgcccctgctgtccttaaccctgttcacggcaggaaaatactcttcaccttggccaagcagagcaaggccctcggtgcctacaggctggcccggcacgcctatgacaagctgcgtggcctgtacatccctgccagattccaaaagtccattgagctgggtaccctgaccatccgcgccaagcccttccacgacagtgaggagttggtgcccttgtgctaccgctgctccaccaacaacccgctgctcaacaacctgggcaacgtctgcatcaactgccgccagcccttcatcttctccgcctcttcctacgacgtgctacacctggttgagttctacctggaggaagggatcactgatgaagaagccatctccctcatcgacctggaggtgctgagacccaagcgggatgacagacagctagagattgcaaacaacagctcccagattctgcggctagtggagaccaaggactccatcggagatgaggacccgttcacagctaagctgagctttgagcaaggtggctcagagttcgtgccagtggtggtgagccggctggtgctgcgctccatgagccgccgggatgtcctcatcaagcgatggcccccacccctgaggtggcaatacttccgctcactgctgcctgacgcctccattaccatgtgcccctcctgcttccagatgttccattctgaggactatgagttgctggtgcttcagcatggctgctgcccctactgccgcaggtgcaaggatgaccctggcccatgaccagcatcctggggacggcctgcaccctctgcccgccttggggtctgctgggctgtgaaggagaataaagagttaaactgtcag

SEQ ID NO: 1326 - DNA, 1936 bp, Homo sapiens
agtgacgccagggggcggggccagcggcgcgggcgggtgagaggccgcggcggcgggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagagaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctgttatctatgactttctggctgtggatgatataaacggggacaggatccaagatgttctttttctttataaaaacaccaacagcagcaacaatttcagccgatcctgtgtggacgaaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggggaaaccctgtggaaccacagcagcagcttcagcgggaatgcgtccatcctgagccctctgctgcaggtgcctgatgtggacggcgatggggccccagacctgctggttctcacccaggagcgggaggaggttagtggccacctctactccggcagcaccgggcaccagattggcctcagaggcagccttggtgtggacggggaaagtggcttcctccttcacgtcaccaggacaggtgcccactacatcctctttccctgcgcaagctccctctgcggctgctctgtgaagggtctctacgagaaggtgaccgggagcggcggcccgttcaagagtgacccgcactgggagagcatgctcaatgccaccacccgcaggatgctttcccacagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgagaaaacccatcttcggccgctacaaaccagacaccttggctgtagccgttgaaaacggaactggcaccgacagacagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggagaccggggaggcccggcacagcctgtacatgttccaccccaccctgccgcgcgtgctgctggagctggccaatgtctctacccacattgtcgcctttgacgccgtcctgtttgagccaagccgccacgccgcctacatccttctgacaggcccggcagactcagaggcacccggcctggtctctgtgatcaagcacaaggctcacactgggcgacagcggagaggctcttggacggggcagagctcgcgccgagacctgcatgtccgcgtcttgtgacgggtgtgtgggaagccgcccgcctgtgcatcttgcttccgggtattcgctggctgatttactggttttagagatggggatgggcacccagtgctggactgaagaccagagaaggtgg

SEQ ID NO: 1327 - DNA, 2011 bp, Homo sapiens
gctgctgtttcaagctcgttcgcccaaatacatctttctacccaccttccctatcgtcagagaggtggcctgaccccagcacgtgcaagcttgtcaggctggaagaggactgtcagaaggacgtagaaggcacggttttactgtgaggagcaaagattctttacctacgcattttacaagaaatgtgcagaaagccattgataaatatacctgcaaatccttgtcatccttttcctccagcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaaatgttatttgaagggaaagtgaaccctcagacccagagtctgctggccgaatgcggggagtggacaagaagatccctccatttgagagtattaggaagacagctgatcctgcccactgacgaaggcgtccagcatttccagggcagcactcctgcctccgcagtccacagacccccgctcagtgcctgcggacacagcagcaacatcagagagttgtgcatttctggctctcaaatagtcccagcagcactctcagcctctgccctgccaggccctgatgacacaggggttgctgacctaacggcacgttcatccctggaagaagaggtttaccatgtggatggaaagattgaggagtatttcgcttttgacagaaaagaggatgatgatgaatgtcttgaacaaaaaccagctcagcccggtaggaaatggcgcgaactcggacttcctcctgtttccccgcgtgactgtgtcaaagatgccgtggcagcagaagtgtttgatcacgtctggacaaatatggtagaacttttggaagagctgattagaaaacactgggaaactacactcacagaagggaaaaaacagagagaaacattgaaagtggctggaaacagatttccgcacgtcctcgttccacgcgctcacgccgatggagccagtggccccccgtccggacacgccgaggctcacggcatctccctggcttctcgtctgaacctgccccagattcatcacttctccagcagtttttatagtgacatgaatggtgtcatgacaattcaagcaaaaccgcttcagcggagacctgcctattttgctgacagaacgcagaatgagaaggaggacaaagcatcgggtggaggggcaggtgctctctcctccgcaccgcacagactgggacgggcctcagacactcatggattatcaccttctgcaaagaaaacaccagtgccctggaggctgccttctcttgcttcagattcacagagactaaaaactcccaacatctatagtgacgaagttcttcggggaacaaaactgccgactggcgtggaccacatggcttccccactggttcaaacgtcacggagcaggttccccccgctagtcacggagaccagggggcagaatacagcagttcctggatgccgccttgtttcttacagaggaaggcatctacaaaaccgtgtgttgagtgccatgcctgacggtacagaacgatcgcgtcttcgagaaagaacagccaccctggaacggttgtcaaggcccagcacaacccacacgttccggcagtcggatacgcctcgaaaaagttcattgacacaaatggaatttgctgctcacacatggacaggtcaaagtattttgacaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttg

SEQ ID NO: 1328 - DNA, 1800 bp, Homo sapiens
atttaccgccgcgcggagagtgagggcccaagtccgccctgctccgccacttaggccgccccagacgcttccctcggggctgccaccgggtcgggcgcggctgccgcggctagcgggccttccccgcaccggcgcggcccaaccgccaccgaaccttctggaagcggcggctgcctgggcccccacgccgccagaatcgtacgcccgcgcgagctctctgcagccttggcggcctgggaggcggggctcggggtggggccggcgcgggggcggggtcggcgcggggaggccgcgttcgattcgcccccggcgcgcaggccccgcctcaccagccccatcgctccacctctgccctccccctttatggcgcggcccgggctcattcattccgcgccgggcctgccagacacctgcgcccttctgcagccgcccgccgcatccgccgccgcagcccccagcatgtcgggcccagacgtcgagacgccgtccgccatccagatctgccggatcatgcggccagatgatgccaacgtggccggcaatgtccacggggggaccatcctgaagatgatcgagggggcaggcgccatcatcagcacccggcattgcaacagccagaacggggagcgctgtgtggccgccctggctcgtgtcgagcgcaccgacttcctgtctcccatgtgcatcggtgaggtggcgcatgtcagcgcggagatcacctacacctccaagcactctgtggaggtgcaggtcaacgtgatgtccgaaaacatcctcacaggtgccaaaaagctgaccaataaggccaccctgtggtatgtgcccctgtcgctgaagaatgtggacaaggtcctcgaggtgcctcctgttgtgtattcccggcaggagcaggaggaggagggccggaagcggtatgaagcccagaagctggagcgcatggagaccaagtggaggaacggggacatcgtccagccagtcctcaacccagagccgaacactgtcagctacagccagtccagcttgatccacctggtggggccttcagactgcaccctgcacggctttgtgcacggaggtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctagactccctcctcctgccactggtgcctcgagtagccatggcaacgggcccagtgtccagtcacttagaagttccccccttggccaaaaacccaattcacattgagagctggtgttgtctgaagttttcgtatcacagtgttaacctgtactctctcctgcaaacctacacaccaaagctttatttatatcattccagtatcaatgctacacagtgttgtcccgagcgccgggaggcgttgggcagaaaccctcgggaatgcttccgagcacgctgtagggtatgggaagaacccagcaccactaataaagctgctgcttggctgg

SEQ ID NO: 1329 - DNA, 2519 bp, Homo sapiens
tttcaggtgaaccagaacagcacctcctcccacttaggaagctcgtgatttccaggtaagcctgtggacttcactgggggttcccgctgcttctgggtggccccggagccacttttctgaaaagccacttttctgtccttccagagcctccctggggtagacatgtccactagggtgggctgacccagccccatcagaggtttccatggtgacagactgggggtgctatttatagaatcaaggcttagttttctagctctggatcaaggacagggagagggattaacgctgaaccaaccagaaaaaggtttgtctgacactggggacagggcaggaagcaccactatgatgggggagggggagattctggaaccatttttgcacagaatgctgtctgccagtctggcttctaaaaacagcatcagcgttgggccagagcaattaatgttctaataacagtcacaagtcgttctgttctaagaataacccccatggccgttgggccaggtactggtcctgtgttactcatttaaccctcagcatccttgggaggcggatgacatgatcattccattttacagaagagaaaaccaaagcacagagaaggaagggctttgacttgcccaaggctacacagccaccaagggacagaattcctcccaggtttgcttttagtgaatgattttaagtgcacatttatccatccatattctactaaggggtggggaaagggatttttttgaacttggtaattcaaagatttaagatctccaggtttaactcccttcagcccctgttttcttcatctggagaatggggattcatcattgcccacctctgaggttggccatgagatggcgtgagctggcccaggtgggagtgcttggaaaccgtgaagtgctgggcccttgctgtggacttgggcactggagttaaggctgcatgagtgagctcacttccttctgtcccccagcctctatgatcaggttaaaggaaacctcaagagaggttattttacatggaaacaccttccagcttggactcttatttttagtctctgtatctatttttaaacaatcagcatatgttttagtttttctttcaatttactttgctccaacctgcaaggactctgtcattattagggttcccatcttgagttgcactaagatcccagagtttttgtttttgagacagagtctcaccctgttccccaggctggagggcagtggcacgatctcagctcacagcaatctccaccttctggggttcaagtgactctcgtgcctcagccttccaagtagctggggttacaagtgtgcgctaccacacccagctaatttttgtatttttagtagagacggggtttcaccatgttggccaggccggtctcaaactcctggcctcaagtgatctgcccacctcagcctcccaaagtgctgggattacaggcatgagccaccacacctacccaagatcccatagttctattccaaagaaaagaaccctctcatgaaaaacagctttcctccctgttcctcactaactgttccctcgctgcctttctgcagatcattagtagaatcctggaccttctcattgacaaaagcagatttgttacttgttttactgtttaaatgagataccatatagaggtgctttagctgaatcctgggtacagagttggccttgaacaaacatgagtccttctcttgcctccaagaattcatcagtatttatcacataatcactgtcatttgctctgtgtccataagaaaagtgtatatttgaggtcaagtggatgcaagatgagatgtggggaagaacccaggaaacgtttttaaatttaaactctctctggccatctgggatgcattcttaaaacattacatgcttatgcgaatggatgaagacagtatgttctgcaatcacatgtataaatataaatgatctatttcagaattgttactctgagcctaacacagtcttccccactttcagatctccgcaaatgacttcattgccaagaagagaagaaaatgcatttaagtggaaatcggacctctaatccaagcatattgcttgctattaatcgccaaaacaggactgctgatgaggaatgtatttgcatatgtttgcaaaagctgaatcattgaaaacgtaccttgaaactctctatctctggacactccagggtagagaatgaagggtatggaagtagtccggcttttgaaacttaggtattttatatttttcccctcaagaacttttttttaagagacagatttgccatcctccttaatttgcaggactgccttggtggctttgtttgctgggacaaggcccacaacctgtgcctctcctattgacccttactttgaattcaaagaatctatttaagagtttaatatatgaggctttctttgattcctcctcagttctacctagtttcacagaggaaaaaaatactctttgaataaagtgaacagaggctcatttgtttgtgcctcactttactg

SEQ ID NO: 1330 - DNA, 2423 bp, Homo sapiens
ttagccttcatgagtgtccccaccatggcctggatgatgcttctcctcggactccttgcttttggatcaggagtggattctcagactgtggtgacccaggagccatcgttctcagtgtcccctggagggacacccacactcacttgtgacttgagctctggctcagtctctagtacttactaccccaggttctaccagcagaccccaggccagtctacacgcacgctcatctgtaacacagacactcgctcctctggggtccctaatttcttctccgcctccatccttggcaacagagctgccctcaccatcgcgggggcccaggcagatggtgaatctggttattgctgtgtatcttatatggaaagtggcgtatgtcttcgcaactgggaccaaggtccccgtcctacgtaactggctctcaacctttcccagcctgtctcaccctctgctgtccctggaaaatctgttttctctctctggggcttcctcccctctgtcctcccagccttaagcactgatccttacctttctccatggggcctggaggaggtgcattcgtctccgggtaagcggcaggagtggcctccacagcggaaggagccggatgcagcctggtcccggggcctgagctgggattgggcagggtctggactcctcctctcttccagggcacctgtctgagtgagggacagaggttgcctctgatggggggccctgcagtgtccttagggacactacccagtgactcctggggtcaaggacagaggctgctggggtgggcctgggaggtgctgagtcccatagtctaggggagcagccccaagaacagctgagggtctagactgaggactggatgccagtgcagcctgggagggccacacggcctggtgacacagaggtcaccccaagggcagaccaatggggggcacagagagggctctgggtctaggctgcagctctgtggcctgtgctgggtcatgaggacatggggacacagagggacgggtgagactgggtgaggtgccagaatccaaccctcccaggacagtcaccagaagggggacagtctcttagggcagagatgtgtctgtccctggagccccgtcacctctggggcccagtgtctctctgttcacggatcggcctcctgccttcctcaaagggcatgttagactcaggaaatgaccagaggggagtgaatgaggggtgcagagaactccatggctaccaggtgaagtttggggtcatcacaggctgctggggtgggcctgggggctgctgagtctcatagtctgtgggagcagccccaggaacagctgaggtgaagggttctgtggtcgggcttgtggagacaggaaacatctcagagcctcagaggagccctgaggcttgtctaggtggagcccactccttgccaggagagccaagtgggctgggctggggcagagcccggtgcctgtgagggataggaagctccagttcaaagcaggcttgggtctccccacacactgcctgccaggacagtcctacaggatgagcaggggacccacagttcacggaggaggctctaggtcctggaagaataaagtgggtgatggaggggggtatagggatggaaatgagggatccaggggtcaaggccagattctaaactcagactccagagatcagagaagaaggaacacagcctgccctgggtacatggagaaattgaggctgtagaggagaggggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttccctgtccacacaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccag

SEQ ID NO: 1331 - DNA, 1861 bp, Homo sapiens
aaaacacccctcatccagtctcttccagcctagagatcctggcctacccctccgccaaagcgcgcactgagtgcaaaccccagagtcaatccctgtcccggctccgccccccgcgtccgaatcccgcccagccgggccctcaagcccagtcgggactcgagcctagggaggcgaggttcccgcaccggatagaaaatgtcactgaaattcacaaatgcaaaacggattgaaggacttgatagtaatgtgtggattgaatttaccaaattggctgcagacccttctgttgtgaatcttggccaaggctttccagatatatcccctcctacatatgtaaaagaagaattatcaaagattgcagcaatcgatagcctgaatcagtatacacgaggctttggccatccatcacttgtgaaagctctgtcctatctgtatgaaaagctttatcaaaagcaaattgattcaaataaagaaatccttgtgacagtaggagcatatggatctctttttaacaccattcaagcattaattgatgagggagatgaagtcatactaatagtgcctttctatgactgctatgagcccatggtgagaatggctggagcaacacctgtttttattcccctgagatctaaacctgtttatggaaaaagatggtctagttctgactggacattagatcctcaagaactggaaagtaaatttaattccaaaaccaaagctattatactaaatactccacataacccacttggcaaggtgtataacagagaggaactgcaagtaattgctgacctttgcatcaaatatgacacactctgcatcagcgatgaggtttatgaatggcttgtatattctggaaataagcacttaaaaatagctacttttccaggtatgtgggagagaacaataacaataggaagtgctggaaagactttcagtgtaactggctggaagcttggctggtccattggtccaaatcatttgataaaacatttacagacagttcaacaaaacacgatttatacttgtgcaactcctttacaggaagccttggctcaagctttctggattgacatcaagcgcatggatgacccagaatgttactttaattctttgccaaaagagttagaagtaaaaagagatcggatggtacgtttacttgaaagtgttggcctaaaacccatagttcctgatggaggatacttcatcatcgctgatgtgtctttgctagatccagacctctctgatatgaagaataatgagccttatgactataagtttgtgaaatggatgactaaacataagaaactatcagccatccccgtttcagcattctgtaactcagagactaaatcacagtttgagaagtttgtgcgtttttgcttcattaaaaaagacagcacactggatgctgctgaagaaatcatcaaggcatggagtgtacagaagtcttgatttgtgcagaatggattaatgtttctgttagatgacctagtatggaattgttacttagtgctgccacctgctggatgttaaaaggtatttcagtacaactggaatttaaatatttccattgtttttccaaagcagttaacccaactcctaacaacattttcgggggatctgaccttttttttccagttgaaatgtattaacacaccttccacaatcattttataagagtcagcataacatagtggataagaaatgtgagatgtttaacctctcagtaactcggttctctcattataaaataggaataaaatcagtacctgtttcatatgaaggtcgtttctgagaattaaatggactaatgtatgcaaaaagcctggcaaacaataaacactcatctgacttt

SEQ ID NO: 1332 - DNA, 1847 bp, Homo sapiens
aggaagccctcccgacgccccggctgagccagtcgtttccgagttctccggcccctgatggggacgtctgcgcccctcttctcaggccagaggtgcagagatatacttcccccgtcccggggctcagccagcactgctaggtacacagaaggtgtccagcgagtgtagctcagggcatcctgcgggcgggctgccgctccgttccgcgtgctcgtccgctgcgcccaggctgggcgctttcacgcacctggtcccatctgcacagggttgtgctacgagccaaggactggctgccaggagctcctgggggcaccgcagtgtgggccaccagcttggaagcagaggtcccaccagatctagcgctcaataaggagcagcagctgcagatctccaaggagctggtcgacattcagatcacaacccaccacctacatgagcagcatgaggctgaaatcttccagctgaagagtgagatccttcggctggagagccgggtactggagctggagctgcgaggagatggcaccagccagggctgtgcagtcccagtggagtctgaccccaggcatccccgggcagcagcccaagagctcagacacaaagcccaggtgcagcccaagaacaccatgaaccccgagaatgagcagcacaggctggggagcggcctgcagggggaagtgaagtgggcgctggagcatcaggaggcccggcagcaggcactggtgacgcgtgtggcaaccctgggccggcagctgcagggagcccgagaggaggccagggcagccgggcagcgactggccacacaggctgtggtgctgtgcagctgccaaggccagctccgtcaggcagaggctgaaaatgcccggctgcagctgcagctcaagaaactgaaggatgagtacgtcctacggctgcaacactgcgcccggcaggcagtggtgagccctgcaggagcaccctgaggcctagggagcccaagcctggcctgggtgtgctggatagcttcagggaggccccagggccccggcactgctcagcctgctggggtggggggatggttggaaaagatggggggtgggccccatgcggacccagcccaccgcctccaggagcacgcagatggtgcaggccaagcgccagccaccacggccctccggacattcctggaggcgactctggaggacatccgggcagcgcaccgcagccgtgagcagcagctggcccgggctgcccgcagctaccacaagaggctggtggatctgagccgcaggcatgaagagctactggttgcctacagggcacctgggaacccccaagctatttttgacatagccagcttggacctggaaccattgcccgtgcccctggtcactgacttcagccatcgggaggaccagcacggcgggcctggggcactgctctcatccccaaaaaagagacccggtggagcctcccaggggggaacatcagagccacagggcctggacgctgcatcctgggcccagatccaccagaagctccgggacttctcccgcagcacccaggcagagctggaacgggagcgggcacagctgctggtccgggccacgatggctgaagagcaactttctgagctacaggagtacgtggaccagcacctgggcaggtacaagcacgaaatcctgaggctgaggaagctggcaggtacaggggacccctggaaagtgggggctgtgcctccagccaagccccagcatccaaggaccggcagccactaggccgtctcccaaggagcagagcagagcagagctcctcagccagcacagaaccctcccacccagccccccataaaacatgagtcaggatag

SEQ ID NO: 1333 - DNA, 2240 bp, Homo sapiens
acacagagcctgggctgcgacttgaaagagtttaggcagcaacagagtgaccctgggggtgctcctgaccgacagccgcacccccggcgtctaggacctccgagcagggatgcatctggaggtctagggaagcacttccaccccctcctctcctcaatcctggcaggatgtgcccgaaatgccagctcctccttggtgttctcctttcaggatttgaattcaaatcccattggcagccctgataccgctgggggaagggtgaggctactgctgcttcaagacagtgacgtttctctccggtcagctgtcaggagcgctggtgagcttcctactgtgccacaaggtgcgggtgctggagacacagctgagcctggaaatgagagtgggcatcgccgtggtcatcatgactcctctgcggcgtggtcaccatgttggttcactgtgttgggctcttattgacgggtctcctgctaggcctgaccttgggtgccggagccctgctggcttctgagcctatctaccaaccaccttcagcctgggtgccagctggggggctggtggggctggcgctgctgggagccctgctcacacttcggtggccacgtccattcacagttctgggcacaaccctgctgggttctgcagtgcttgtggcctgtgttgactacttcctggaggggctggcactggggagttggctgggccaacgcctgcagacacttccagccttgccttctctctgctgatatagctgggtcttactggggatctggccagccttgggggcccttggagccctggcccagtggaagctcgtgcctgaggaacatggaggccacgctaatgagttacttccagagtcttcaagagtgccaactgggaccaggaccccagaccacagccccccacaccgtcctggacctggattctgactgtggttccactgtacccctcaccttaatctctggttcctaccagacctgagcctagacttccactttttcccttacccctgtgagggcctgggaacactaggtgggcagggtttgagcccacaggacctgcacacaaacttccccacctcttggacttggggacaggatctgtgcctcaacccagaccagctttgtagggatatgttccaagaacagagaagagtcttatggggaagggggaggaagggaagtatgaatatttacctctgaccaataatagaggtgccctggtccccaaagaaattgactcccgaattccctccaagccttacccatatagcttttgtttgtttgtttgttttcagacaaggtcttgttctgtccagtgccgtggcgtgaccacagctcatgacaactttgatttccccggcccaagcgagcctctcattcagcctcctgagtggctgggaccacagacgccacacacagctaatttttatgtattcgtttttatttttttgcagagacagggtctccctatgttgcccaagctggtcttgaactcctgggctcaagtgatcctcctgcttcagcctcccaaagtgctaggattatagccaccgcacctcgtcttgaaatagccttttaaatgttcacctcagcttgcctcacagtggtaaaaataagcatttttttgttttgtaggatcagggagcttccaaggcatttgatacctttttgatgggaagaagggctctgaggagctccaagataccccaacctccaggcccttcattagggggtagttgggtttctgtttggcctttccccctgggccccataggcttaaactacccccacccccacctccgcctcctacctcagctgggagcactgtcttccatggggcttccacttctctcctcaacctggggaagaccacagggcagtgcctgcctcaggacctgccttccccaaaagctggcttcttgctccaaggagagagcattgacccacctgccagagtcttgccttttgcccaaaggagcctggtcttcagggctgcataggatgcaagtgccttctctgcttctcaccgtgggtggcactaatttcctccttaaccagaactttgttccagccactgacccattctaactcttccccctctgactctcctgcgcagggtctgttcctggtttcccagatgcataaaggaagacatatccctcccctgggcagcaaggctacaatgggagggagggagaacatgggagcatgtgaataaaatggcattaaatactg

SEQ ID NO: 1334 - DNA, 2032 bp, Homo sapiens
gtgcatccctgccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggaccccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggcaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtctt

SEQ ID NO: 1335 - DNA, 2876 bp, Homo sapiens
aaaaaaaactctggggatctatcgagagggcagttggcgggactgggcactccccttccttctccctcccactgtccccagaaatcttcccatccctccacctccccaagccctaagtcctctcgggctctgcccttcagggcagcgggtgttggggatgtccagctcctgagccctcttgcacggaggctctgcacggaggcaagacaaggggttcagctctgtcccttatctgaggtgggagggggaagggaattatggaaggaatccagctggcctgttagtaagggtgttccagtgctaggtggaggtggagtttggctgcctttggggagtttggaagggtgaggaatagaggcctgatttctgagtgttgtttctgtgttggacaattctatgcaaactagagccaaaatggaagagggtgcaagtcccctcctggggccccagacgccccctcctttcttgctgcctggagcaggggcagtgctgttagtggctactcctggtgtgaacagcccatcctggccaccttccacaggaaacctgacctgaaggacagaagaggaaggaagcaggctttgccacaaatgtcagtgcagaactctggctggccccaccaagaagacagccccaagccccaggatccaggtccaccagccaactcagacagtgactcaggccacctgccgggggaggaccctgaggatacccatgctcagggtcctgcagttctgagcttgggttccctttgcctggacaccaaccaagcccccaactggactggacttcagaccctcctgcagcaactccctccgcaggacattgatgagcgctactgcctggcccttggggaggaggagcgggccgagctgcagctcttctgtgccaggcggaagcaggaagccctgggacagggggtagcccgcctggtacttcccaagcttgaaggacacacctgtgagaagtgtagggagctgctgaagccaggggagtacggagtgtttgcagcccgggcaggggaacagcgctgctggcaccagccttgctttgcctgccaggcctgtggccaggccctgataaacctcatctacttctaccatgatggacaactctactgcggccgtcatcatgcagagttgctgcgcccgcgctgcccggcttgtgaccagctgatcttctcctggcgctgcaccgaggcggagggacagcgctggcatgagaaccacttctgttgccaggactgcgccgggcctctgggcgggggacgttatgccctgcctgggggaagcccctgctgccccagctgcttcgagaaccgctactcggatgcaggctcgagctgggccggggcactggaagggcaggcattccttggggagactggactcgaccgaactgaaggaagggaccaaacctcggtgaactctgcaaccctctcccgaacactccttctcgctgctgccggcggttccagcctgcaaactcagagggggctgcctggatccagtccccagcaggagaaccgacctggggacaaagcggaggcacccaaagggcaggagcaatgccgcctggagactattcgtgatcccaaggacacccctttctccacctgctcctcctcctctgactcggaacctgaaggatttttcttaggcgagcgccttccccagtcctggaagacccccggaagcctccaagcagaggacagcaacgcctctaagacgcactgcaccatgtgctagtggcgcagctcagagaggggatgtgagtgggaggaaaggggtctgtaaagcgggagaacaaggctagcctccccctaacaatcctagactgagacgcagtcaggcgcacgcccgcaagaggcggcgaggtgacaagtttggagtgcgcccccttcagtactgcgcgttctaagacttttggcggagactttcttggcaaaacccattccccaaagctacgcttcccctgctgagatagcccctacccccacctccacaggctgggacagccccgtccccaccatcctcctcccaagccaattaaatgatcacagcacgcgtgacagttaccggctggagagccggaggtgggaccgggagcaggggaccgtagaaccgggccgcgctcctcccctcctagagttcgtggaggcgcagcagagggccgtccctcttccggatgtcggactaagcgaacagcgcccccactgccggccggtagcagccggaagtgccagaccggaggtgcgtcattcaccggcgacgccgatacggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaactcgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggc

SEQ ID NO: 1336 - DNA, 2098 bp, Homo sapiens
aggcctgcgcgaccctccgcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatgtacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttct

SEQ ID NO: 1337 - DNA, 2164 bp, Homo sapiens
agtcacagcagccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgcggccagagcagcgtcgagggatatatacggtgcagtggtggtagagaaggggtccaactcatgagagggaccatgtagaaaagtgaggggagctgtcagtgtctaacagattgggacagtgttgtgggggtttaggggctgaggagccctggatagcagagacacttggaggagatattgaagactggtgggagaatggtaatgaaaccctatgggtcaatggaacttctctttcacaagctatgaaactctcctggaactcagaggccctgacagatttatatttaacaaattaataaacagattgttaaatggaaggcaatagagaataggagttaaaaatataggttctggagtcagaccatctgaaattatatcctagctccttcacttggtactctggggctaagtatttaacttctatacctcagtctccccatctgtgaaacagggatggtaacagtgcctattctgtctgggttgttgtgaagagataattcatatgtcaatagctaataagcagttctgattttattgtgactaatcatggattagattgaatagtcaagatatctttctattaccagcaactgaactagtagcttcaagggatacaaagatgagtggaacatatagtttccaccttaggaagtctagctgaggaattaaggtgtaaatttactgacagtttgaataaccaggatgttgtatagggatataaagccagaacaccactggacacaatggcttatgcctgtaattccagcactttgggaggccgaggcagggagatcgcttgagcccaagagttcgagaccaggctgggcaacatagtgagagcccgtctccacaaaaaatgcaaaaattagccaggcatggtgatgtgtgcttttagtaccagctactcgggaggctgaggtgggaggatcgcttaagcctgagaggtcaaggctgcagtgagccatgttcgcaccactgcactctagcctgggtgacagatttagaccctgtctc

SEQ ID NO: 1338 - DNA, 2158 bp, Homo sapiens
ccagagccgcagccgcagccgccgctacagtccgggccgggctccaccgcgcatcctgctccactctggcgaccgcccccggggtccccgccgcgggcgcggcgcccgccatgggcgaggaggactactatctggagctgtgcgagcggccggtgcagttcgagaaggcgaaccctgtcaactgcgtcttcttcgatgaggccaacaagcaggtttttgctgttcgatctggtggagctactggcgtggtagttaaaggcccagatgataggaatcccatctcatttagaatggatgacaaaggagaagtgaagtgcattaagttttccttagaaaataagatattggctgttcagaggacctcaaagactgtggatttttgtaattttatccctgataattcccagctggaatacacacaggagtgcaagactaagaatgccaacattctaggattctgctggactagttcaactgaaattgtcttcataacagatcaaggaatcgaattttaccaggtattaccagagaaacggagtctgaaactcttgaagagccacaatctcaatgtgaattggtacatgtactgccccgagcgcgccgtgatcttgctgtctaccacggtcctggagaatgtcctgcagccttttcactttagggctggcactatgtcgaagctgcccaagtttgagattgaattaccagctgcgcctaagtcaactaaacccagcctttccgaaagagacatcgcaatggctaccatatacgggcagctgtatgttctcttcttgaggcatcattctcggacctccaacagcacaggagcggaggtggtcctctatcatctaccacgagaaggtgcctgtaaaaagatgcacatattgaagttaaataggacgggaaagtttgccctgaacgtggtggacaacctggtagtcgtgcatcatcaggatacagagacatcggtaatattcgatatcaagttacggggagagtttgacggctccgttaccttccaccaccccgtgcttcctgctcgatcgatccagccctatcagatccccatcacaggtcctgctgccgtgaccagccagtctcctgttccatgtaaactctattcttcatcttggattgtctttcaacctgacatcattatcagcgcaagccaaggttacctctggaacctccaagtgaaacttgagcccatagtaaatctcttaccagacaaaggaagactcatggactttctcctccagagaaaggaatgcaagatggtcatcctgtctgtctgttcacagatgttaagtgagtcagacagagcatcgctgcccgtgatagccactgtttttgataaactcaaccatgagtataaaaagtacctggatgccgagcagagttatgcgatggcggtggaagcagggcagagccgaagcagcccgctcctcaagaggccggtgcggacccaggcggtgctggaccagtcagatgtgtacacccatgtcctgtcagccttcgtggaaaagaaggagatgcctcataaatttgtgatagccgtgctgatggaatacattcgttctcttaaccagtttcagattgcagtacagcattacctacatgaacttgttatcaaaacccttgtccagcacaacctcttttatatgctgcatcagttcctgcagtaccacgtcctcagcgactccaaacctttggcttgtctgctgttatccctagagagtttctatcctcctgctcatcagctatctctggacatgctgaagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactat

SEQ ID NO: 1339 - DNA, 2204 bp, Homo sapiens
attcctcattgataactgctttgaaatatttggggagaacattccagtgcattccagtatcacttctgatgactccctggagcacactgacagttcagatgtgtcgaccctgcagaatgactcagcctacgacagcaacgaccctgatgtggaatccaacagcagcagtggcatcagctctcccagcaggcagccccaggtgcccatggccacagctgctggcttggatagcgcgggcccacaggatgcccgagaggtcagcccagagcccattgtgagcaccgtggccaggctgaaaagctccctcgcacagcccgataggagatactcagagcccagcatgccatcctcccaggagtgcctcgagagccgggtgacaaaccaaacactaacaaagagtgaaggggacttccccgtgccccgggtaggctctcgtttggaaagtgaggaggctgaagacccatttccagaggaggtcttccctgcagtgcaaggcaaaaccaagaggccggtggacctgaagatcaagaacttggccccgggttcggtgctcccgcgggcactggttctcaaagccttctccagcagctcgctggacgcgtcctctgacagctcgcccgtggcttctccttccagtcccaaaagaaatttcttcagcagacatcagtctttcaccacaaagacagagaaaggcaagcccagccgagaaattaaaaagcactccatgtctttcacctttgcccctcacaaaaaagtgctgaccaaaaacctcagcgcgggctctgggaaatcgcaagactttaccagggaccacgtcccgaggggtgtcagaaaggaaagccagcttgccggccgaatcgtgcaggaaaatgggtgtgaaacccgcaaccaaacagcccgcggcttctgcctgagaccccacgccctctcggtggatgatgtgttccagggagctgactgggagaggcctggaagcccaccctcttatgaagaggccatgcagggcccggcagccagaccgtggggagcatgacggtggggagcatgagggcgaggatgctggaggcgcactgcctcctaccccctcttccacctgctcaccacgtagaggactcaagacacaggggcagcaaagagccactccctggccacggactctctcccctgcctgagcgatggaaacagagcagaactgtccatgcttctggggactctctggggcacgtgtctggcccagggagacctgagctcctcccgctgaggaccgtctccgagtccgtgcagaggaataagcgggactgtctcgtgcgacgatgtagccagccggtctttgaggctgaccaattccaatatgccgaagaatcgtatatttaggagggaggccatacgccatgccatagcttgtgctatctgtaaatatgagacttgtaaagaactgcctgtagattgtttttaaaaggtcttgaataagctccttgagaaagttgtggaaagccctcctcagtgaggatagctacaccatggccatggcgcatcagatagtctctgtgtacctggatttgtgcaatatgtaaaaatgtatcaaatgtattatagataaggtgttaggtgcaaaggatgtctaataatccctgcacacgttttgaacttgcagtgaagtacactgctgttccttgcttcctggggcacttttctcttggttagtgtttaaaaattatcttcgcttttttaatgtggcctcaaatgtcatgccaattttcacatcttccacaaactccatttagggagaaatgtttaaatctctggtataagtttactccataccagagtaaactatatattactctatataagcagtcttgcaataactaatcaccaccatagaagaaagaaacagactgcaaggaacagagttgagtgtctggagtcatcaaaggcattaaaaactccagtaaaagctggggccgtagcaaaaatcatgaaaaacacttcaacgtgtcctttcaatcatccaattaaatgtgggtagattaatgaaaatgtattacatcaatattaactcatctatagcactttgagtatctttgtagttcatgatatcctatcctataatgtggaggtaaatgattttatatgcattgggggtcatatataaaacttcaatgtaatttcactacaataaattgccttccttatttgaaagt

SEQ ID NO: 1340 - DNA, 2179 bp, Homo sapiens
ttcccaaagctggactccaatcactcttagcaccctcctcttgacaaaactggatttgagtttccatattgttcatcattacccctactgggtccgccgggatagagcaaagacttgctaatgtttgagagtgaacgtttaaacttggtgagagcttgtgaacattttgccaaaaggaggaagaccacctatagaattaatcaaaggctgttcattcagacgttactatgctaagggagttggctactatcactttccttccaaatgagactagaagtcgtttgaaagaagtgttagttttatagagataaaggagagactcttaagactgtctttgattgatgagtgttcttttaagatgcgattattctattatggggggatttttgaaagtggagtcgggagaggctttctgattgtcatccaagtacatttggtattctttgatttgtttactatctactggtgcgtaacttggggtctttccagggttagcagcctcctaagagttttcctgtctgaattggaagactgtctcatccttggttctggggtccaaatctttcatcagcaattcctcagtgtctttactcgtattatctcattctgccttctctgcaggaaggtggtaggggagaagggacagaaggaagaaagagaaccatttatgtagcacctccagtgtctagcactggactttgattagaaaaagtaatcaataaacatatgtggaatgaattgcattatagagttcctcgtaagatttctccctatttcatactccccgcttccaccctccaacctcccccaaataggaatctctttgagaacagggaatctagattctaccagagttctgcactgtgctttcctggaacaagcattaagttttcagccaaactggattggattcaaatctgacctccacccccttgaacacctgtgactaggaaaatacctggttcatagggtagtagtaagtagtcaatgatcagatgttgcatgtaaagaccttgcacatagtaaagacttcatagatgttctttttcttcctctagtgggtccataacaaatatttgcttgatatcaaatgtgaaacactagggccaatctgagatgtaggttaggagacccctgacactttgtaatttatcttgatagcactggagaattacagagatgtacaaatgccagacaaaagtattaagagtctaaagtggttgcctccaagaagaggatagagagtagtggtcaaggaaccattacattttgttttagagtttcaaatattcagattcctggtctccacctcatactcatgaaatcagaatcacttaggatggagactgggacctgcattttaaataatcttttcaaagtgttctttagtttgagaactaaaaaagcaaacaaagcaaaccatagtggtgaactctgaagatgtttcctggtgaatccaaagacgagttactctgctatcccccatttggttcctaaatataggacaaaaagttgataaatcatagatggagatgatgactggtgctttcagagagccttgacacctggtaccagacccattttctacccgtggtctaaatcggctgcgacatgtagaagcattggcttaaggtgaatgaacagctattctacgcttttgctgtgtcaaaatggcaattgtgaactgcttgaacagtaactatggccataggcaatagcactattgaaagcattctgcactctgatatcagactgaagcacagaggtagacattgcaagtgttgactctgtgatttaaaagctccatgaccctggaccagttacttaacaatctcaattccttgatctgtggaaaggggattatgatagtacctattttgccaatgagatgcatcctcaaacacttgagatcccagtggctgttacctaccataccttcattatttgactaagaactctttttcgtgtgtttatttctttagtatttacatctgtgaacctcagttttcctattagtaaaatgaaggtcaagtatgacatcttatttgagctgtgagttgacagtgtaacacttctcataaactgcatgcatttgaaatatgaagttgtaaaactctacgattaagctttgtatttctagcaccttggctatactgtttcttattcagttaattgttgc

SEQ ID NO: 1341 - DNA, 2255 bp, Homo sapiens
ggataaaaccccacaccaccctcctgttctccctcactctcctccagccatcccacggatcctcaaccagagaccttgctcatattctctgcctcccaaatcttacatagacatacttcttttatttttttgagacagggtctcgctctgttttccaggctggaatacagtggtgagatcacagctcactccagcctcgacctcccaggctcaagtgattttcccacctcagcctcctgagtagctgggaacataggcgcaggccaccacgcccagctaatttttgtagtttttcataaagacgaggtttcaccatgttgcccaggctggtcttgaactcctgggctcaagcgattctcccacctcggtgtctcaaactgctgggattacaggtgtaagccactgcacccagccaacacacttacctcaatctataatccgtctgtttgtgagagtgtggtctcggggttgggggccaggtccagggactggttcattcactgctctgtccccagcatcatttagcacaaggatggacacagaagattctttcccgctatttacctgtgttcagagtagtgattgcaaggactgacccatgggtatcactatagacttcacagattttgataccagtgactacttttgggatgaatgaattaataaattaatgaaaaagtaatgcaaaggctgaaatacacctgaactcatccttctggggcaaccagaagtcatagaagggtttcgggtagggaagtggtgactgggtttccagcagcacccagttgagaggcaggtgcagagtaggcaccttggagatacttgttaaatctcagtccagccaggtgttggtcatcacccagggcagacagcagcaagagatgggcaggagggagggcatggcgcagactgttcatggaggacttctgagagcacaaggaggaggtctcaagctgggtcacaagcctgaagcacgaagtccccttcctccctttccttctgccccaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggggtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacgacccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggtgccctcacctctgcctcaagcctcccgtgggaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttc

SEQ ID NO: 1342 - DNA, 2203 bp, Homo sapiens
atgtgtcaagtgcctatgaaggggactgcccatgaagtgaaagtcaagtgtgtgttgctgcggcagccacggaggccaaggacctcacgggagtaaaagatgacgagactggcttcgggagaaacaccatccagaagagacctttcaaaaaacttctagagactccccaagacgtatgagatgaaaggcttcttctgtctgtgtgcgtttaactcatttctccttagccccgagattacgcgctgctgtgcctgcgactgcagcgtttacgccgagataactcgtggattacagtgccaaccttactcccaaagtttgccacgaaatatctcgcttctgttattttcgcatggttctggtatattgacttttgaaacaaaagacatcattctgtttatagcattctgtttttagtagtgggatttccatctacaaaatatagtaattctcgatcgctgaaatgtcaaatcctagaaaacgtagcattcctatgcgtgatagtaataccggtctcgaacagttgttggctgaagattcatttgatgaatctgatttttcggaaatagatgattctgataatttttcggatagtgctttagaagccgataagatcaggcctctgtcccatttagaatctgatggaaagagctctacatcaagtgactcagggcgctccatgaaatggtcagctcgtgctatgattccacgtcaaaggtatgactttaccggcacacctggcagaaaagtcgatgtcagtgatatcactgacccattgcagtattttgaactgttctttactgaggaattagtttcaaaaattactagagaaacaaatgcccaagctgccttgttggcttcaaagccaccgggtccgaaaggattttcgcgaatggataaatggaaagacactgacaatgacgagctcaaagtcttttttgcagtaatgttactgcaaggtattgtgcagaaacctgagctggagatgttttggtcaacaaggcctcttttggatacaccttatctcaggcaaattatgactggtgaaagatttttacttttgtttcggtgcctgcattttgtcaacaattcttctatatctgctggtcaatcaaaggcccagatttcattgcagaagatcaaacctgtgttcgactttcttgtaaataaattttccactgtatatactccaaacagaaacattgcagttgatgaatcactgatgctgttcaaggggccattagctatgaagcagtacctcccgacaaaacgagtacgatttggtctgaagctatatgtactttgtgaaagtcagtctggttatgtgtggaatgcgcttgttcacacagggcctggcatgaatttgaaagattcagcggatggcctgaaatcatcacgcattgttcttaccttggtcaatgaccttcttggccaagggtattgtgtcttcctcgataactttaatatatctcccatgcttttcagagaattacatcaaaataggactgatgcagttgggacagctcgtttgaacagaaaacagattccaaatgatctgaaaaaaaggattgcaaaggggacgactgtagccagattctgtggtgaacttatggcactgaaatggtgtgacggcaaggaggtgacaatgttgtcaacattccacaatgatactgtgattgaagtaaacaatagaaatggaaagaaaactaaaaggccacgtgtcattgtggattataacgagaatatgggagcagtggactcggctgatcaaatgcttacttcttatccatctgagcgcaaaagacacaaggtttggtataagaaattctttcaccatcttctacacattacagtgctgaactcctacatcctgttcaaggaggataatcctgagcacacgatgagccatataaacttcagactggcattgattgaaagaatgctggaaaagcatcacaagccagggcagcaacatcttcgaggtcgtccttgctccgatgatgtcacacctcttcgtctgtctggaagacatttccccaagagcataccagcaacgtccgggaaacagaatccaactggtcgctgcaaaatttgctgctcccaatacgacaaggatggcaagaggatccggaaagaaacgcgctatttttgtgccgaatgtgatgttccgctttgtgttgttccgtgctttgaaatttaccacacg

SEQ ID NO: 1343 - DNA, 1524 bp, Homo sapiens
gttttcccgacgttgccacatctcaggtgaataagttctatgaagcgctcacactagtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgcggtgcccgcaacctggaccagcaggagctggtgaagcactgtgtggaaagccaccgcggcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagcgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccgcttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggtggggccggcagagaaggggcctcctccacccagagtcctggccttggcccgctgtcaccttcaaagctgactgtgccccgctgcgggaggggacggcaccccagtggtggcagagcttgggggcctgggcaggggcccgcttggcgggccgggcaacacgtcaacattcttttctgttcttggcattaattattgctgtctttttttaaaaaaaaaaagtttaaataaaatgtctcagagc

SEQ ID NO: 1344 - DNA, 2040 bp, Homo sapiens
gctccctggctggccggtttgagcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccagtatagccgaaatacagaaagatgtggaatacagattgccattcaccataaacaacctgacaattaacattaatatactgcttcctccacagtttcctcaggaaaaaccagtgatcagtgtttatccaccaatacgacatcacttaatggataaacaaggagtgtatgttacctctccattagtaaacaattttacaatgcactcagatcttggaaaaattattcagagtctgttggatgagttttggaagaatcctccagttttagctcctacttcaacagcatttccttatctatacagtaacccaagtgggatgtctccttatgcttctcagggttttccatttcttcctccatatcctccacaagaagcaaacaggagtatcacttctttatctgttgctgacactgtttcttcttcaacaacaagtcataccacagccaagcctgccgctccttcatttggtgtcctttcaaatctgccattacccattcccacagtggatgcttcaataccgacaagccaaaatggttttgggtacaagatgccagatgtccctgatgcatttccagaactctcagaactaagtgtgtcacaactcacagatatgaatgaacaagaggaggtattactagaacagtttctgactttgcctcaactaaaacaaattattaccgacaaagatgacttagtaaaaagtattgaggaactagcaagaaaaaatctccttttggagcccagcttggaagccaaaagacaaactgttttagataagtatgaattacttacacagatgaagtccactttcgaaaggaagatgcaaaggcagcatgaacttagtgagagctgtagtgcaagtgcccttcaggcaagattgaaagtagctgcacatgaagctgaggaagaatctgataatattgcagaagatttcttggagggaaagatggaaatagatgattttctcagtagcttcatggaaaagagaacaatttgccactgtagaagagccaaggaagagaaacttcagcaggcgatagcaatgcacagccaatttcatgctccactatagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttctttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaacc

SEQ ID NO: 1345 - DNA, 2019 bp, Homo sapiens
gttgttcgctgcggcgaccagctccggaaagcgcggtggggacgcgctgtgttctcgcagctcagaggcgggtctgaggctcggtggcggcgcccagggtggcccgggccctttcctctgtcgttgtctcaccgccacaggctccgatggcggcggccacgctgagggaccccgctcagggctatgtgacctttgaggacgtggctgtctacttctcccaggaggaatggagattgcttgatgacgctcagaggctcctctaccgcaatgtgatgctggagaactttacacttctggcctctctgggacttgcatcttccaagacccatgaaataacccagctggagtcatgggaggagcccttcatgcctgcttgggaagttgtgacttcagccatactgagaggtagttggcaaggagccaaggctgaggcagctgctgagcagagtgcttctgtagaagtgcccagttcaaacgttcagcaacaccagaagcagcactgtggagagaaacccttaaaaagacaagagggcagggtcccagttttgaggagttgcagagtccacctatcagagaagtccttgcaaagcagggaagttgggaaggatcttctgaccagctcaggtgttctcaagcaccaagtgactcacacgggagagaagtcacataggagctccaaaagtagggaggcctttcatgctggaaaaaggcattacaaatgcagtgaatgtgggaaagcctttggtcagaaatatttacttgttcagcaccagagactgcacactggggaaaagccttatgaatgcagtgaatgtgggaagttatttagccataagtccaacctttttatacaccaaatagttcacactggagaaaggccttatgggtgtagtgactgtggaaaatcctttagccgtaatgctgacctcattcaacaccagagagttcacactggagaaaagccttttacatgcagtgaatgtggaaaagctttcaggcataattccacacttgttcagcatcacagaatccacactggagtaaggccttatgagtgcagtgaatgtggaaaattgtttagtttcaactccagcctcatgaaacatcagagagttcacactggagaaagaccttataagtgcagtgaatgtggaaaattctatagccacaagtccagccttatcaatcattggcgtgttcacactggagaaaggccttatgagtgcagtgaatgtgggaaattttttagccaaagctcaagcctcatgcaacatcgaaaagttcacactggagaaaaaccttttaagtgcaatgaatgtgggagattctttagtgagaattccagccttgttaaacatcagagggttcacactggagcaaagccttatgagtgcagggaatgtgggaaattttttcgccacagctccagtcttgttaaacatcgaaggattcacactggagaaatacaatgattgtgagaaatcctttagctggtgtttcaacctcattcaacaccagaaagttcacggtgtaaaaaagtcttgaaggttactaatggaaatccattagctatacctccaaactcattcaacactggacagttcacagagtggacaatgtagtgaatatggtaaaaggcctcagccaaaggcctaaccgtattcaacaccagaaagtttagactggagaaaggccttagactgtcgctgaatcaatatgacctgacttaaagcagaaacagccaggcgtggtggctgacacctgttattctcaccactttgggaggctgaagcgggcggatcacaaggtcaggacatcgaaaccatcctggttaacacaatgaaaccacatctctactaaaaatacaaaaatttactgggcatggtggtgggcgcctgtagtcccagctactcaggaggctgaggcaggagaatggcatgaacctaggaggcagagtttgcggtgagctgagatcacgccactgcactccagactgggtgacagagtgagactctgtct

SEQ ID NO: 1346 - DNA, 1683 bp, Homo sapiens
atcttcgtgcagccgccgcgggtccgtgcgcccagcgtcccagggcccaggccgagcagacaaagatcattccactcagcctgggacgatggggaggaaaaaaatccagatctcccgcatcctggaccaaaggaatcggcaggtgacgttcaccaagcggaagttcgggctgatgaagaaggcctatgagctgagcgtgctctgtgactgtgagatagccctcatcatcttcaacagcgccaaccgcctcttccagtatgccagcacggacatggaccgtgtgctgctgaagtacacagagtacagcgagccccacgagagccgcaccaacactgacatcctcgaggtaccccagacgctgaagcggaggggcattggcctcgatgggccagagctggagccggatgaagggcctgaggagccaggagagaagtttcggaggctggcaggcgaagggggtgatccggccttgccccgaccccggctgtatcctgcagctcctgctatgcccagcccagatgtggtatacggggccttaccgccaccaggctgtgaccccagtgggcttggggaagcactgcccgcccagagccgcccatctcccttccgaccagcagcccccaaagccgggcccccaggcctggtgcaccctctcttctcaccaagccacctcaccagcaagacaccacccccactgtacctgccgacggaagggcggaggtcagacctgcctggtggcctggctgggccccgagggggactaaacacctccagaagcctctacagtggcctgcagaacccctgctccactgcaactcccggacccccactggggagcttccccttcctccccggaggccccccagaatatggcctgggagaccctccaccgccccctggcttgttgcagccccccaccctggccccctggcagccctcgaggggtgatgggccccccgccgtgtcctcccagcccaggtaagtgccctgagacgacggcaagtcccagtcctccaaagccccggccgctgctgacccctggtggccatccctggtactgcgcacacttccggtacggatgggcagctattttgaggccccaagagggaccgccaccccctcctttcccagggtcctcctgccaagcctttgcccacgctgtgccatcccctggcttccttcccttccttgctgagctcacggcctccctctctctttccccctgcagtgggggccgaagcctgggcgaggagggtcccccaacccgcggcgcctccccgccgacccccccagtcagcatcaagtctgagcgcctctctccggcccccgggggccccggcgactttcctaagaccttcccctatcccttgctcctcgcccggtccctggcagagcctctgcggcctgggcccgccctgcgccggctgcccttggccgacggctggccccggtaggagatcacccggtggcaccagcccagagcgctcgccaggtacggcgagggcacgtggggaccccacctccctccaggcctcttcagagaagacccaacagtgacgcccccctccgcggtgggggcttggaggtgggcggctggactcaatccaccctggggggctcctttccttcttcctatttgtgtgtatatccacaaataaaacgcgcgtggcgtccgtggaccag

SEQ ID NO: 1347 - DNA, 2072 bp, Homo sapiens
tttactgtccacgtgagcatagctgctgtccagggccagcccagcacaggcacagcagtgggtgacagtcccagaaggggatcccccagttggcctcagggtctctgagtgtaccaggtcagccggacccagaaagggccaaggagggctggtcgctgttggttgcaaactcctgaagctgcttttgacgtgtggtggcacctgggctggaaattggaaaaacacgcgggttcgtttctggacccacagtccgcctcgctcttttactttagaaggaattgctccaagcagagtctacacaggtttcccctgtggcttttcttcagagagcgtgttgaccccagctagtgtcacggttctcacactgtgatctcagggccgttgacattccccaggattacggaggacctcagagagctttcccttttgaaactcactgttgcagagtccagacacaaagtggatcttagaagtctagaatgtgaagctgactttgggttgatctggaggtagtgatccttggaaaatttggaaataacctggcaaatgtcacctcgtgagctggcagcgttttgtgacaaaatgacaaaggctgtgacagaagggtccagactgacccctgcgacgcagccagggaagtgggacagagagggatggacagctgtcctgcaggaggcagcctgacctgagagctcccctttaaaaacgtttggtgaggaagggcccctctctggctcgccgtttgtagtaaatgagctgggcttgtgggcctgaccgtctgtcttgcttgggaaaggggaggaagcccctcagcctggcttccccagcccttctgggagccagcactgtgggtgattgggttttcccagggtgagcgtcggagcctgtggggctggtgccctgtgtgtggggtctggtgggcctgtccacctctcagtggaggtgtggagcggcccctcagtgaggacacgcagtggggggttttctgccccagcccaggagtgaacggcgaggctagtgggagacaggagcgtgctcctgcagcccagtgcctgcacccagggcagtcagggatggcgccttcctgggtcacacactccccacgcttgtgggtggtccccgcaaacccttgcctggccttgtgggcatagcaagaatgacccctgcctcgctgaagctgctgctctctgcttcctcggtctattaatagggacccaagtctgaaaagaagaaacgcaggcggggcagaaaagaggagcccgaaggtggtagcaggccggcgtgtgggggagctggcacccaggggcctgtgcagctggtcaaggaggtggtggccgaggatggcaccgtggtcaccattaagcaggtgctcaccgcgccaggctcggcggggcagccccggtctgaggacgaagacagccttgaggaggccggcagccccgcacctgggccgtgtccacgctccaacgccatgctggctgtgaagcatggggtgctctacgtctatgggggcatgtttgaggccggcgaccgccaggtcaccctcagcgacctgcactgcctggacctgcacaggatggaggcgtggaaggccttggtggagatggacccaggacgtagccaccaccgtcccgcagcctcccccacctgcctcagctgcgctgacgtgtatgtgcgttcattctgcttttgaagaaactcaggagtggctggaggagacggactcggaagaggacagtgaggaggttgagggcgccgagggtggggtcgacgacgaagacagcggagaggagagcggtgcggaggactgagaagagcccctgccaggggcgcctggcaagtgctgtgcccacgtccgcccaggacccagccgtgttgagtgaagctcttggggccagcgtgcgtcctgacgcacaggagagagctgaaggtgggtggcccaggccagggtgtgaactttctcccatggtttagtctctgacgcggcactgggccggaagttcaactgagtgcagtgcaggtggattccctcagcagcctgtgtgttgtgtgaaataaattggacttgaaac

SEQ ID NO: 1348 - DNA, 2049 bp, Homo sapiens
agtggaccgctgtgcgcgaaccctgaaccctacggtcccgacccgcgggcgaggccgggtacctgggctgggatccggagcaagcgggcgagggcagcgccctaagcaggcatccccgcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggtgcgtggggagggttgggcgttcctgaccccgactgggaggtcagcccgagagactttgggtccctgggggtgcgacggtgccccactaccagcaccggccccagggtgccccaccgctgtgggctgccaccctcacgcgtacccccacataccaggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggttagaaaccacctcctttccagacgggagcctataccgcacatgcagcaaccagtccatccacaggcagctcccaacctcaagcctggcccaaagcctccaagaccctaccaaggcttctccccaccctgctccccagcacagttctccccaccccgttccccagcacagcgcttggggcccctctggctccagaccaggccccttggagcaggaaaaagatccactgatggaattcagacccctttccccttgggtccccagacagctcccccaagggaggagctgaggacttccctccctctgccccaagccttgtttccccaaggacaggtaccaacctcctcccctactgacacttctcaaccaagaaaacttcctttccattccctcaccagctgggcacccctatagctgcttaaatactttccaaatccagctgcactcctagccagggaaggtgaagggatgcacagaggtgggggaggggtactgtgcagggtactcagcatccctgaccaccaggtgccaatgatcagcggacgtggtctggggcacacaggaggcaccttggataagctggagtctattcctgggttcaatgtcatccagagcccagagcaggtacggggcgccacggatcagtcattaatccaggttgatgatggagaccctggccagaatcactaaaagatcactggtggatcattagggtcactaatgagaacactggtcaaggttactcatgagtcactgggcctgggccgaaatcatcagtggaactttgattaggatcataaaatgggaagttggtcaaaatcacagatggctggcggggcacggtggctcacacctgtagtcctagcacttggggaggccgaagagggcagatcccttgaacccaggagttcaaaaccagcctggataacacggcaaaaccccatctctacaaaatagttcgctgcgtgtggtggtgcacgcatgtggttccagctactcaggaggctgaggcaggaggaccacttgagcctgggaggtctaggctgcagtgagccgggacgatgccactgcactccagcctgggcaacagagtgagaccctgtcccagcactctgggaggcagaggagcccagttggagatcagcctgggtaatatagtgaaacttgatctctacaaaaaaaagaagaaaaaaaaaagccgcgtgtggtggtgcgcacctgtagtcccagctactgggaagctgaggtgggaggatcacttaagcccaggaggcagaggtcacaatgagccgaaattgtgccaactgcactccagcctgggcaacagaggaagactcttcacag

SEQ ID NO: 1349 - DNA, 2181 bp, Homo sapiens
tgtaattctaaaagagatcttatttaaatttcctttttaaaagccgcatggttctgtgatccatgtaactgacactttttggctttcagtgctgtttagaaacagtggcaaaggcagggtggtgctgcctgcaagctgctgcctatggaaggcaaagtcatagtaatgagatagcacctctgaactgtgcagtcagcataccctgagtgatggctcaggggcgcactacctattttgtcaccagagctgactcaggcttcctggaccctcaaccccagatcattccaggcagcatagctttcttcacagtcctttcagaattcccaggctgaaatcagccatagcagttgacaaaacagctatccccacaagtgatgagatagtccctttactgtcctcaaatggacttggccttagagacgtggtaaagcactttggcagggtttaaaatatttgtgagaagcccacatttcagtatacatcctcactggcttccatgcacccacctgacggtagcctcacagaagtcctggctgtcactcaggtggggagctcatggtgccgctggggactttttagagaaatgtaaagagaatagctattcagtgtctactagcagagcaacatgtgtcaatttaaccaaattcacaaataaccctccatttttcaatatctgctactgtaaacatgaatattgaatactgacaagagaatacccatacaaatcgtcccaccgccctagaggccacagaattagcccaaaattatcaaagaacattaactggaaggtcaggtttttcaaggaacatagcttacaaatgcatcagtgtgtatctggagagcatcctaactgcatttcaactcatcttttaagtgatttcagtcaaaactggaaaacaactaagatgtagtaatttttttttcctggttcaaaccttcaataacttgctcattcagcagtctctctgagctacatttttatttgtaaagtgactctgtctgcatggcaatgagcaggtgcgtgttttttccacattcgccctttcttgcagtatccagggaaacacatcattacaaagggtttctacctgaaatctttcatggaaggcctacaattcgaaaagctgcacatgtttacagaagagctcttaccctccatgcaaacactttgctctgtggtgtcacagctttgtgacaataagatggcaatctcggatctacaaggtgctgtcgggaatcaaataaaatatgttatcagagatatcatcacatctatagtgtttaacagagctttatgccaactactaagacaaagctttaacaaagtttatagaatactgaaactcgtaacaattacctctctacgtgatgctgtaaggaatcttgctaatttggtaggaagagggagcatttaggaaagggtttagtatctaccaaaagtacttgacctcaagtaaccaatagtaatgcaaacttgctttaaaggaaccaaaggcattgccaagtatttgccaaaaggaggcactttttatttaaaatttgagactaatgagatctcaaaaatcagccccaaaaaggtattatccatttaagtttataattttcactaagatgtagatatttctcttattgttttcatgtaaaatagtatagagttgttttgttggtttaagagtaacattcagtagtaatacaaagttttttttctatgtagaaattagttttcttttcttgcttgcaatagaaatgcaatgtgataggtgtttctcttcttattttcattgccacattatgtcttagcatctcactttatgaaaaaaaggagaaagataccaatctacagagccctgcttgttgaagcactagtttaatcaacaaaaaattatggcaatcgggggtccattcatctattgcctttatgttgttttttaaaagaaaaaccatgatgcctttgtatttgctgtttgcacccctgaaatcaattccatatcatgtttgaatgccatacattttgcacatgtactgtacataagtaatgcatactgtatttttatatgtgtgcacatttatcatcagatcttttgtacatagtggcagtattgtagctgatcgggaaatgtttgatatctcagcaattttgcatttttgtgtctcaaataaaagacattttgatgtactatg

SEQ ID NO: 1350 - DNA, 2090 bp, Homo sapiens
atgagtagccagccagggcagaggccgggctgcaggtggaggcggggaagcgattccggccacctttgtgatgggcgtctcactacctacaaagtcagcccaatgatttcaagacagccctggagacagtgcttcctgccctcctgtcagcttctgcctccctgtaatgtgttctgggtggtctagctcagtcatctggagacacacacagtttgctgtggaacgttgtggcttctgtggctcctcaggcccgggggcgccccttgaaccctccactcttggctccaagcaccttccctgggaagctgtatctgctgggttcgcagacaggaacagaaacatggatggagccatgtggctgagcctctgtcctgataacgaagacctgctttggaggaaaaagcacaaattgctacaagcccggggcaaaggcgatctcgctctgcagagaagagcggatgccaagctgtggaaaaactaccagctccagcgcttggctgaggagttgaggagagggtatcaggaggcacagcacctgcacgtcggtggcctggacaggctgcagtcagcacgtctgttgggctggggaggaggacgggccagggaaaatgagcctgactcgcaggggcccatccagcgaagatcagccaggcccccgagggccaaggagaagcatagagcagcccttagtgaagagaggagttgcagggaagagttgggccagcaacaccccaggcactccaggccccggaagacagcagcgagtccagagaaaccacagactacaaaagccacgggtcggatgaattctcacctggccccgcctgagaagagaaagggaaggccagaaccttcgaccaagtctgggggtggccgctgtgccatccatcctcggaggagcaaaggggcggacctagaaaggtcaaacccactcgtggctgctgtgggagaaatcgggcttgtggaggaaaaagagaaaggaacagctcgggcggggaggaggcaactgggaaagggggcagtttgctttgttccagccctgaccagtcgctctcagggacagagtctggaggggaagctgagagacctcgggcagctgtggccagctgattccagctgcagaagggaagccgtgtccccagcatctcagtgcacgctccgggagaagaacaagtggcagaaagagctggagttggcctttgaagagttgtttaatataaacagaaagctgaaaaaacacctgtgcttgtacctggcactgaagcccaggatggaccagagacctggggaagggcatgccttctcagagatgcaagagtgtggcgctgggaccccaagagggaagaaaatggcagacccagagatgctgcctgccggggaacccaggagcccagcagaggaggaggcgcagcaggcagcgtccaagaccgacttgaaaacgttcatgggcaaggcccagaaccaaaaatatcagggcacggtcaagcccacgtttagaaatggaagtcaaacattgtctcccgaggcaggtatatttatcaacaaagaggactcattattgtatagcactgaatctggacaagagacccccaaactgggcacgctggcagagggctcccttcagctccaccttcaagaccaggcagacagagtgggctcgacggcatccaggcaaaggcagaaagcagagatggagcagagaagacaaaaacaactggaatcgcttgaacaaatggaacacccagatatgagcttggaaatccactacaaagctgagctagaaaaagagaggagggagcaaagaagagctcgactggcccatctgaagtcctcctccacgagagcccaggaaagggagagaggatctgagctcagcaccacttccccatcgggcaccagcctcgccgacgacgaccggcacagtcagatgatccgagaccagcagcagcagatcttacagcaaaacaggttgcacaagcagtttcttgaagaagcccggaaatgcttgcgggagtttcagaacatatgctaaatgcgagaggcccacccggggtaaatacatcactgataatggtgctgccagcactggt

SEQ ID NO: 1351 - DNA, 2342 bp, Homo sapiens
acgcgcacctcccccaactcaactgccgttcgtcgttcgtggatgtccgttgtgtcccgagactaggacgtggctccaggagtgctcgggccagctggtccttttcccatccctccccatgaaggagggaggctggtagctttgccagcagctgcgccgcggcaggggtggcccatggacctgcccgagggcccggtgggtggccccactgcggaaatgtacctccgggagcggcctgaggaggcaaggctgggaatgccggtcagcttggaggagcaaatactcaactccacgttcgaagcttgtgaccctcagaggacaggcactgtggctgtggcccaggtgctggcctacctggaggctgtgacaggccagggcccccaggatgcacgcctccaaacattggccaacagcctggaccccaatggggagggccctaaggccactgtggacttggacactttcctggttgtcatgcgtgactggattgctgcctgtcaactacatgggggattagagctggaagaggagaccgccttccagggagccctgacctcccggcaactgccatctggatgcccagaagctgaggagccagccaacctggagagcttcggaggcgaagaccccagacccgagctacaagccacagctgacctgctgagcagcctggaggacctggagctcagcaaccgacgtctggttggggagaatgccaaattgcagcggagcatggagacagctgaggaggggtcagcacgccttggggaggagatcttggctctgcgtaagcagcttcacagcacccagcaggccctgcagtttgccaaggccatggatgaggagctggaggacctgaagactctggccaggagcctggaggaacagaatcgcagccttctggcccaagcccggcaggcggaaaaggagcagcagcatctggtggctgagatggagactctgcaggaggagaacgggaagctgcttgccgagcgggatggagtgaaaaagagaagtcaggagctggccatggagaaggacactttgaagcggcagctctttgagtgtgaacacctcatttgccaaagagacaccatcctctctgagcgcactcgcgatgtggagagcctggcccagaccctggaagaatacagagtgacgacgcaggaactgaggctggagatttcacgcctggaggagcagctgagtcagacctatgaggggcccgatgagctacctgaaggggcccagctgagaagagtgggctggaccgagctgctacccccatcgctgggcttggagatcgaggccattcgacagaaacaggaagtggcaactgctgatctctccaaccctctgtgtggggtgtggcagtgggaggaagtcatccatgagaccagtgaggaaactgagtttccatctgaagccccagctgggggacagagaaacttccagggagagccagcgcaccctgaagaaggaaggaaggagccatccatgtggttgaccagaagagaggaagaggaggatgcagagagccaggtcacggctgatctccctgtccctctaggagcccctcgccctggagacatcccagaaaaccctccagagagacctgcgcggcgggaactccagcaagccctggtgcctgtgatgaaaaagctggtcccagtcaggaggagggcctggggccagctctgcctgcccccacagcggctcagagtcactcgacatccactgatcccagctcctgtcctgggcctgctgctgctgctgctgctctctgtcctgctgcttggcccgtccccacctcccacctggccccacctccagctctgctacctccagccccctccagtgtgagaggctctacttgcccctcagagcagtgtctagctcaataaatcccctggccctctctccactgggatccccattgttagtccactgttgcgcaggcttaccctagatagagtacaggggatccacatccctgtatttttatgtgaagtctcctagttttttaatgctgacatttcttaacaatagcaaaactcccccagtaatggattaagcactaaggattattccctcacaaaacaagcctggcgagggcagctgtgggcacacagctaagtctcggttgccttggggtcagggcctcagtgattctcctgtcccctccctcatgctcaggagttggcagttgtagcttcctacatcacatctgcgggaaacggaaatttcttccttcctttttataaagagaggcagtagcctcagtgtgcagtgggtagattcaaatcatattcataataaaagagaagcagttgcctgcccag

SEQ ID NO: 1352 - DNA, 2490 bp, Homo sapiens
gtttgttcctagcaaccagcctgaggtctggaggtggtgcggagggagccgcctagggaccagggactcctgccatgaatccgccggggtccctagaggccctggacccgaacgtggacgagcacttgtccacccagattctcgcgccctcggtccactccgacaactctcaggagcgcatccaggcccggcgcctccgcatcgctgcgcgcttagaagcccggaggcgggaagcacttggagaatatttagatgggaagaaggagagtgaggaggatcaaagcaagagctacaaacagaaagaagaaagccgattgaaattggctaaacttctgctctgtggcaccgagttggtgacaaatatccaggtggctatagatatcagagagattcacaggagagtcgaagaagaggagataaagcgtcaaaggattgagaagctggagaatgaagttaagaccagccaggacaaattcgatgaaatcacctcaaagtgggaagagggcaagcagaagagaattccccaagagctgtgggaaatgctcaatacccaacagctgcactgtgcgggactcttagaagataagaataaactcatcagcgagttacagcaggagttaaaaacaaaggatgaccagtatgtgaaggatttgaagaaacagtcagatgacatctgcctgcttctggagcggatggaagaacaggtgaagaatgtgatgaaaacctttcgtgaggagctctataacattgagaaagcatttgaggtggaacgccaagagctactggccagtaataagaagaaatgggagcaagcccttcaggctcataatgccaaagagctggagtatcttaacaaccgcatgaagaaagtagaggactatgagaagcagctgaacaggcagaggatctgggattgcgaagaatacaacatgatcaagatcaagctggagcaggatgtgcagattcttgagcagcagcttcagcagaggaaagcaatttatcagctaaaccaagagaaattagagtacaacttgcaggtgctgaagaagagagatgaagaaagcacagtaattaaatcccagcagaagaggaagatcaatcgcctgcatgatatacttaacaatctgagatcaaaatatgccaagcaaataaagcagtttcaggaggagaaccagtctctaacctcggactacaaacgtcttgtgatgcaattcaaggagctacagaaagccatgaggcattttgctcttattgatgatgagaagtttcgggagatttggctgatgaatgaagaggaggcgaaggacctaatagccagagcctttgatgtggacaggatcatccacacccatcatctggggcttccctgggcagcacctgatttctggttcctgaacaatgttgggcctatttctcagcagccccagaagtccgccacacagatagtagaagaaatgcttatgcgctcagaagaggaggaggcagaagaggccgccgcggaaccagagtcctacctggatttgccgaagcaaatttctgaaaaaactaccaagaggatcctgatgctcctgtgtgacgagtcggggttcctcatagagagcaagctgctgagccttctcctgcccctggagcagaatgaatgctatctgctgaggctggatgccatcttctccgcccttggaattgaaagtgaggatgacttgtataaactggtgaacttcttccttaaatatcgagctcaccgtttatcttccagcctccagatcaagccctgcagtcaggcgagcatggagaaggcgagcatggaggagacaagcacgaggtcagaattggagctggcagagcagacggagatggagggagaaaaggaagaaagcctggtggaaggggagaaggaggaagaggaggagaccccaccctccccctgggtcatccaccccaatgatgtcctcaagattctggaggccttcgtcatgggtctgaagaagcctagggactcgcgggccccgctgagggtacagaagaatgtgcgtgacaactccaaggactcggagtactggcaggccctgaccacagtgatcccttcctccaagcagaacctctgggatgccctctacacagccttggagaagtaccaccttgtcctgacccagagggccaagctgctgctggaaaacagttctctggagcagcagaacacagagctgcaggcgctactgcagcagtatctgaactccaagatcaactctgaactgcaagttcctcccactcaggtgttgcgggtacccacaaaatgagctggaccgccaaaggctgatgtgttagggctggcctgatgctggtgtctgtgccggagccagctcatatcacccactgggccgcacctgggcctgctctctggattttccagggctgtctttatagcctgtcgaaataaggagccagaggagttacctgtgtcctgcattatgattaaagccttttaaagtt

SEQ ID NO: 1353 - DNA, 1758 bp, Homo sapiens
agcgctgaagcgggtcccggaggagtggccacgacccagcacaggatgcagagcttcctgactctgctgaaggagcatgaggacacctgtgcacccccggcggagctggtggcccttgcgggcagactgtgccgggacttccaggatgaccttgcccaactgcagcctttggtcacagccattctggacagccagctccgcctgcatctcctggacaacgcagatgtggccctggcgtgcgcccgtgtcctggaccagcaggagcagcagcaggcggcttgccgcctcctggaggggtgccaggtgccgggaggcagccaggagttagtgcagctctggaacgacatccactaccgtctggtcatgaggaggctgggcgtggctgcgctcaccccggtgcagaagttccgctgcaggaagaggaaccccccgcccccctccctctgcccagaggggctgaagagccggaacttccccagagaggttcgtgagaagctgcacaatttcgctgtgggggtgaacaccaaccccagcaaggctgagagggagaacttggcattggagacgagcttgacccctgagcaggtgtacaactggtttgccaattaccggcgccgccaaagagcccttccccagcacatgaagccagcccagcaggccacagctgaagaccctggtgcgagggagaggggtcctgacctcctgcagccctcaggcaacccccgtgttgactctgggtttgtggacaggcctcagtggtcagaggaacgtgaggaaaaggggcctccacagtccccacagaccacccaaggaccatgggagccactggccttagccccggactttcccgcagatgagtcagtctcaaagccactggatgtcagcggccatccccagagcgtgcaattggaggagggtctgggcacaagcagtggacggacagagctacgggtgggcagcttcctggtgacacagcccccactgcaagctcctgaattcatcctcacccagagccctccagagctggccccagccccatctgccttccccggccctgtgtctgccatggagctgagccaggtcctgccctccagccaggtgcagtgttctgatagccaggcctctggtgatgccttctggggagccaggatgctccttgagttttcagggagcagcctgggctgagctatccccaggagccagacagcaccccaggaggagcgggtgtggatggtctccctggtcaacacaaggagttacagagctttatcctgaatacaaaatgaaggtccccagagttcccctgggggctctgctgaaaagcagagattctttcccactgccatgtttgaatagtttggttagcaattccctgtagtagagaaagcatttgagaaatgttcgtgagatcagaagtcaaaggtgggtctgtcccactcacgcagcactggatcagtcgggctccggggcactcgtgcagagaaggccattctagagaggggagtgttctgctgctggctgccttgccgtctgcccgtgcacacagccagacttttccaccaagttaactgagtgaggtatgaggagtgttctgagatttctgtgtgtaggggcttctcccttgagtactgggaggcaaacctgtctgcgaatggcctaggcagggcagagtagggtggattttccctccaggttgtaattcactgtgtctatgacacaaatgttgtagtcaattaaagtttaatgttttgaactccc

SEQ ID NO: 1354 - DNA, 1970 bp, Homo sapiens
aaaaagatgtagtagggaaaaggagcgacagctggctaaaggggccccccacaaccctccccgacaccctaggaaagcagcctctctccgctgtcccagggtgccatggagatggagagcgcggcggcctccacacgtttccaccagcctcacatggagaggaagatgagtgcgatggcctgtgagatcttcaacgagcttagactagagggcaagctctgcgacgtggtcatcaaggtcaatggctttgagttcagtgcccataagaacatcctctgtagctgcagttcctactttagagctttgtttacaagtggctggaacaacactgaaaagaaggtatacaacatccctggcatttctcctgacatgatgaagctaatcattgagtatgcatacacccggaccgtgcctatcacaccggacaatgtggagaaactgcttgctgctgcagaccagtttaacatcatgggtatcgtcaggggttgctgcgagttcctcaagtcagagctgtgcttggataattgtatcggcatctgtaagttcacggactactactactgccctgagctgaggcagaaggcctacatgttcatactgcacaactttgaggagatggtgaaagtctcggcagaatttttagagctctcggtcactgaacttaaggatatcattgagaaagatgagctcaatgtcaaacaggaagatgctgtatttgaggccattttaaagtggatttctcatgacccccaaaatagaaagcagcacatttcaattttgcttcctaaggttcgcctggccctaatgcatgctgagtacttcatgaacaatgttaagatgaatgactatgtcaaagacagtgaggaatgcaaaccagtcatcattaatgccctaaaggccatgtatgacctcaacatgaatggaccctctaattctgatttcaccaacccactcaccagaccacgcttgccctatgccatcctctttgcaattggtggctggagtggtgggagccccaccaatgccattgaggcatatgacgctcgggcagacagatgggtgaatgttacttgtgaggaagagagtccccgtgcctaccatggggcagcctatttgaaaggctatgtgtatatcattggggggtttgatagtgtagactatttcaatagtgttaagcgttttgacccagtcaagaaaacttggcatcaggtggccccgatgcactccagacgttgctatgtcagtgtgacagtcctcggcaattttatttatgccatgggaggatttgatggctacgtgcgtctaaacactgctgaacgttatgagccagagaccaatcaatggacactcatcgcccccatgcacgaacagaggagtgatgcaagcgccacaacactttatgggaaggtctacatatgtggtgggtttaatggaaacgagtgcctgttcacagcagaagtgtataacactgaaagtaatcagtggacagtcatagcacccatgagaagcaggaggagtggaataggcgtgattgcttatggagaacatgtatatgcggtaggtggctttgatggagctaatcgacttaggagtgccgaagcctacagccctgtggctaacacttggcgcacaatccccactatgtttaatcctcgtagcaattttggcatcgaggtggtggatgacctcttgtttgtggtgggtggctttaatggttttaccaccacctttaatgttgagtgctatgatgaaaagaccgatgagtggtatgatgctcatggcatgagtatataccgcagtgctctgagctgctgtgtagtaccagggctggccaatgttgaggaatatgcagctagacgggacaacttcccaggattagcactgcgagatgaagtaaaatattctgcttcgacaagtaccctacctgtacgagcctcttcatttagctaataaaaagtctaagcaataag

SEQ ID NO: 1355 - DNA, 2633 bp, Homo sapiens
gatttcccggggaggtcccttctgggcccccggcggaggtgggagagagtcaggcaggagccgaggccggggagccctcttcgtcagctggtgctcactgcgccgcgccagcgccagccgggactcacccgcagctccatgcttgtgcccggttcgactcgtccatcctccaagaagaggcagcccatgaggctcccagtccccactgagtgccaccctgaaggatgtcccagctctcctccaccctgaagcgctacacagaatcggcccgctacacagatgcccactatgccaagtcgggctatggtgcctacaccccgtcctcctatggggccaatctggctgcctccttactggagaaggagaaacttggtttcaagccggtccccaccagcagcttcctcacccgtccccgtacctatggcccctcctccctcctggactatgaccggggccgccccctgctgagacccgacatcactgggggtggtaagcgggcagagagccagacccggggtactgagcggcctttaggcagtggcctcagcgggggcagcggattcccttatggagtgaccaacaactgcctcagctacctgcccatcaatgcctatgaccagggggtgaccctaacccagaagctggacagccaatcagacctggcccgggatttctccagcctccggacctcagatagctaccggatagaccccaggaacctgggccgcagccccatgctggcccggacgcgcaaggagctctgcaccctgcaggggctctaccagacagccagctgccctgaatacctggtcgactacctggagaactatggtcgcaagggcagtgcatctcaggtgccctcccaggcccctccctcacgagtccctgaaatcatcagcccaacctaccgacccattggccgctacacgctgtgggagacgggaaagggtcaggcccctgggcccagccgctccagctccccgggaagagacggcatgaattctaagagtgcccagggtctggctggtcttcgaaaccttgggaacacgtgcttcatgaactcaattctgcagtgcctgagcaacactcgggagttgagagattactgcctccagaggctctacatgcgggacctgcaccacggcagcaatgcacacacagccctcgtggaagagtttgcaaaactaattcagaccatatggacttcatcccccaatgatgtggtgagcccatctgagttcaagacccagatccagagatacgcaccgcgctttgttggctataatcagcaggatgctcaggagttccttcgctttcttctggatgggctccataacgaggtgaaccgagtgacactgagacctaagtccaaccctgagaacctcgatcatcttcctgatgacgagaaaggccgacagatgtggagaaaatatctagaacgggaagacagtaggatcggggatctctttgttgggcagctaaagggctcgctgacgtgtacagattgtggttactgttctacggtcttcgaccccttctgggacctctcactgcccattgctaagcgaggttatcctgaggtgacattaatggactgcatgaggctcttcaccaaagaggatgtgcttgatggagatgaaaagccaacatgctgtcgctgccgaggcagaaaacggtgtataaagaagttctccatccagaggttcccaaagatcttggtgctccgtctgaagcggttctcagaatccaggatccgaaccagcaagctcacaacatttgtgaacttccccctaagagacctggacttaagagaatttgcctcagaaaacaccaaccatgctgtttacaacctgtacgctgtgtccaatcactccggaaccaccatgggtggccactatacagcctactgtcgcagtccagggacaggagaatggcacactttcaacgactccagcgtcactcccatgtcctccagccaagtgcgcaccagcgacgcctacctgctcttctacgaactggccagcccgccctcccgaatgtagcgccaggagccacgtcccttctcccttccccgtggtggccccgctccctaaattttttaaaaagacaaaaacaaaacaacaacaacaacacacaaacctgacaagagaaaaacaaacctgaagctgccgagcaggagtggatgcagcctgatcagggtctggagcaaggagccgggctttcctgagctgtggcccggcagggaagatcgcctggacgtggagccagcatcgccccgtgccctcggcgtttgcatttgtaaacttgtggtcttcctatgtgtcagaaacaactgtgtcttgggggggaagaccctcgctgcgccgcttcccgccgcagcgcccgcgcctccgaggggacagcgccctctggagctcgctgggagcatcaccgcctggacgcccgcgccgcggaggagccggcgcccatctccacccgcacggctcgccggtccagagccatgagccaagagccctcttcacgctgctaactccaggggacagacgaagggacatctttggaaaacgctggttttggtttttaaaaagcccaacttttttttttaatttccataactaaagtgttcagactgg

SEQ ID NO: 1356 - DNA, 2312 bp, Homo sapiens
gatgtcacgtccggcggcggcggcagcggcagcggcagcggcgctgagttttgtctcccgggccgtctgggcgcgcgcgggtgtcccagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacaatcattcctggacccccgagggcctctgagtttgagacgctggctgagatcaaatgataagaattccaatttttgttttcctaagtctttcatctgctaatctacccaacatgaaccacgggccacatggagggccagacacattcttaagcggctcacagcctagaggtgcacatctgtgattacaatgtgcaaggtaaaactggatcaacagtttccaaggactggcatgtaataaaatatcctcaaaacaacaagcaagttgggcgtgacttagactttcactgcccatgtagaaggcactgtacattcttgcagcatctcagttggccagcaagaggtgagtcagaaaaaaaaccattcagcagccacatggaagtggggctcgctgggcacaaggcaaaactgtgaagaagataaagtgtctgtggttctgcattgactctattccctggagtcctcccctctcgagttcctagaattatgttatcactcttgctctatctcattcctatcaagacttgttttagaaatgggtgccacagactcagttacattcaaatgtaaacccattcattcatttagcaagttacttattagtgccagtgctgtgtcaggttctacattaggtaccagagtacagtgatgagcaaaaccagtccctgcccttctggaacagagaagactggaagaggatgggggtagccattaatcaaacagtcacagaaatgagtgcaaaatgtagctggagtaagggcttccatggtgaggcacttggtgcagggatctctggatctgaccaaatcaggaggtcaggaaaggcttccgggaggaagtgacactgtgcccagagctcagggatggaagaaggatgctccttctgggcagagagtaaggagagaagattggtgggaaggagggcaggggccagatgccgtgggtgtgatttggatctgtgtccctgccaatcacatgttgaattgtagtccccagtgttggaggtggagcctggtgggacgtgattggatcatgggggtagtttttcatgaacggtttagtaccaaccacttggtgctgttctagtgagttgagtgcattctcgcgagatctggttgtttaaaagtgtgtagcacccttccctcttgctcctgctcctccaatgtgagactccttgctttccctctgttttccaccatgattggaagcttcctgaggcctcaccagaggcagatgccagcatcatgcttcctgtgcagcctgcagaactgtgagccaattaaacctcttttcgttat

SEQ ID NO: 1357 - DNA, 1830 bp, Homo sapiens
actcactcatctccaaagcaaagaccccactatccggcaggtcttagggagcagggagaccctgggggtgggggtgagcttccagagaaggggtttcccatgggtttggccatgagattctgctgttgttgatgttcttattatgggaaggctcagacacagcgcagcaaaggtcgtgttctgcctggggccacagggaccagcccacagccaaccccgttccagccagaggccagcccacgcccccgcacccggtgattttgaagccagtccctgacatcagctgcgttcttcgctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctggcccggagcgggaagcagcattagctctaagatacagcatccaagttgtccctgtcacccagtcgtggggcggcacctgccacagttaattaaaccctctgggcttatctggacgtgattaacgagctgttgatggagaacctcatcgccttgacccagccacttgctcatggcctggactaaaatgagctcctctttctgattcagatgagaaagggacgggggatgtagggcagcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgaggtcctcggtccaagacccgcatctacccagccctgctgtctccttagcatccactggtgctttctgtaggatccacctccgctgtctcaggccacctgtgtggcagcccagaccccaccctggcagtgctgaggcagcccctggcagcggaacaccagcaggtgaagggcagaggccccttgtcgtgtcttcagctctgcctgctttgctgagacctcctcttgcccctggaagggacaaggacattgcactctgcatgatctcctgggactgctgcaaccaactgtcacagcccggtggcaaacagcagagatttatcctctcccagctctgggccagaattccaagatcgaggtgtgggcggggctgtgctccctctgaagcttccagcgggggactctgcctgccgcttccagccccgggtggccccagacactccttggcttgtggccacgtcgccccagcttctgcctccgtctttacacagcctctctcttccccctgtgtctctctgtgtgacccacaaggacatttgtcgttggatttagggcccatcctaatctaggatgttcccatttccagatccttcattccatctgcagtgatcttatttctggacaaggtcacctgtggatctagattctgggagttccgacctggacccatccctcggggccatgattcagccacttccctacaccagcgtggaaaaggggtttttcgtctcttaaattgccacagagcacgtgtgctt

SEQ ID NO: 1358 - DNA, 1826 bp, Homo sapiens
gtagaaccgaggtgggggcttggtgaaggcacaccaggaagagcaggctgcgcctcaccctccagtggagacagagggcagacattctctttggagcacacctcaggctaaatggcaaaaccccaatctcaagtgaacttcatggaactaggggattgtctcacttctccagtggattgaggcagtgctccctctgttctctatgaaatgacggtgtggacaggggatgtggttggcgggggcactgactccaacatcttcatgaccctctacggcatcaacgggagcacagaggagatgcagctggacaaaaagaaagccaggtttgagcgggagcagaacgacaccttcatcatggagatcctagacattgctccattcaccaagatgcggatccggattgatggcctgggcagtcggccggagtggttcctggagaggatcctactgaagaacatgaacactggagacctgaccatgttctactatggagactggctgtcccagcggaagggcaagaagaccctggtgtgtgaaatgtgtgccgttatcgatgaggaagaaatgatggagtggacctcctacaccgtcgcagttaagaccagcgacatcctgggagcaggcactgatgccaacgtgttcatcatcatcttcggggagaacggggatagtgggacactggccctgaagcagtcggcaaactggaacaagtttgagcggaacaacacggacacattcaacttccctgacatgctgagcttgggccacctctgcaagctgagggtctggcacgacaacaaagggatatttcctggctggcatctgagctatgtcgatgtgaaggacaactcccgcgacgagaccttccacttccagtgtgactgctggctctccaagagtgagggtgacgggcagacggtccgcgactttgcctgtgccaacaacaagatctgtgatgagctggaagagaccacctacgagatcgtcatagaaacgggcaacggaggcgaaaccagggagaacgtctggctcatcctggagggcaggaagaaccgatccaaagagtttctcatggaaaattcttctaggcagcgggcctttaggaaggggaccacagacacgtttgagtttgacagcatctacttgggggacattgcctccctctgtgtgggccaccttgccagggaagaccggtttatccccaagagagaacttgcctggcatgtcaagaccatcaccatcaccgagatggagtacggcaatgtgtacctctttaactgtgactgcctcatccccctcaagaggaagaggaagtacttcaaggtattcgaggttaccaagacgacagagagctttgccagcaaggtccagagcctggtgcccgtcaagtacgaagtcatcgtgacaacaggctatgagccaggggcaggcactgatgccaacgtcttcgtgaccatctttggggccaacggagacacaggcaagcgggagctgaagcagaaaatgcgcaacctcttcgagcggggcagcacagaccgcttcttcctggagacgctggagctgggtgagctgcgcaagtagtgaccaggctgggacttgctgcagagtgtggatgagaaattgagtcttcacccaggggatagaagtggagaagcagaggccatcaagatggtgtattttaagcaaaaactaattaacacttttccccaaaaaagctaggctaattaaattattaccaaccatatcctataaagaactcatcttagcatctgcttgctaagaagtgtatacttttccccagtttcaataaacccagtggcaagtgg

SEQ ID NO: 1359 - DNA, 1744 bp, Homo sapiens
gacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacatcaaggctgtagggatcaagcatgtaaacaccaactggtccatacccattcattaataaacttcttaagtgcaag

SEQ ID NO: 1360 - DNA, 2641 bp, Homo sapiens
ggcccgccccgattgcgctgtggctgcgcctggtcttggccctggcccttgtccgcccccgggctgtggggtgggccccggtccgagcccccatctatgtcagcagctgggccgtccaggtgtcccagggtaaccgggaggtcgagcgcctggcacgcaaattcggcttcgtcaacctggggccggtgggtgggaccgggatagacgggaagtgggggcttggaggggactgaacaaccctagaccccgacaagggggagggagcccacaaggtcttctaaatatcaagagtcccagcccacccctgcctcagccaagctcagcttctgggactcccagagagcacctgctggggaaggacaaagaagggggctgttaccggccctcgggggcttcagcaggggagccgggtcccatcggtgcggccgcttccccacatccccagatcttccctgacgggcagtactttcacctgcggcaccggggcgtggtccagcagtccctgaccccgcactggggccaccgcctgcacctgaagaaaaaccccaaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaagggccgcggcgggctgggcacgctcttcatctgggcctcgggcaacggcggcctgcactacgacaactgcaactgcgacggctacaccaacagcatccacacgctttccgtgggcagcaccacccagcagggccgcgtgccctggtacagcgaagcctgcgcctccaccctcaccaccacctacagcagcggcgtggccaccgacccccagatcgtcaccacggacctgcatcacgggtgcacagaccagcacacgggcacctcggcctcagccccactggcggccggcatgatcgccctagcgctggaggccaacccgttcctgacgtggagagacatgcagcacctggtggtccgcgcgtccaagccggcgcacctgcaggccgaggactggaggaccaacggcgtggggcgccaagtgagccatcactacggatacgggctgctggacgccgggctgctggtggacaccgcccgcacctggctgcccacccagccgcagaggaagtgcgccgtccgggtccagagccgccccacccccatcctgccgctgatctacatcagggaaaacgtatcggcctgcgccggcctccacaactccatccgctcgctggagcacgtgcaggcgcagctgacgctgtcctacagccggcgcggagacctggagatctcgctcaccagccccatgggcacgcgctccacactcgtggccatacgggacgttgtaccgctacacgctgctgctctatgggacggccgaggacatgacagcgcggcctacaggcccccaggtgaccagcagcgcgtgtgtgcagcgggacacagaggggctgtgccaggcgtgtgacggccccgcctacatcctgggacagctctgcctggcctactgccccccgcggttcttcaaccacacaaggctggtgaccgctgggcctgggcacacggcggcgcccgcgctgagggtctgctccagctgccatgcctcctgctacacctgccgcggcggctccccgagggactgcacctcctgtcccccatcctccacgctggaccagcagcagggctcctgcatgggacccaccacccccgacagccgcccccggcttagagctgccgcctgtccccaccaccgctgcccagcctcggccatggtgctgagcctcctggccgtgaccctcggaggccccgtcctctgcggcatgtccatggacctcccactatacgcctggctcccccgtgccagggccacccccaccaaaccccaggtctggctgccagctggaacctgaagttgtcagctcagaaagcgaccttgcccccgcctgggtccctgacaggcactgctgccatgctgcctccccaggctggccccagaggagcgagcaccagcacccgacgcctggcctgccagggatgggccccgtggaaccccgaagcctggcgggagagagagagagagaagtctcctctgcattttgggtttgggcaggagtgggctggggggagaggctggagcaccccaaaagccaggggaaagtggagggagagaaacgtgacactgtccgtctcgggcaccgcgtccaacctcagagtttgcaaataaaggttgcttagaaggtg

SEQ ID NO: 1361 - DNA, 1966 bp, Homo sapiens
gttgcgcgccgtggcggcctctgtgcagtcgccggttccggaggagggcccaacccggctgggtgggtgggaagtgtggctggtaacctggcagccgcggagagagagaagattataaatggcagagccatttaactgtggttagctgttggattctgatactttcttaaaaatacgttcttgcaccaacatcttcattgggaacagttcagaaaaagcaaagaggagagccaacattcacatttaccatggctataccaataacagtgcttgactgtgacctcttgctatatggccgtggtcaccggacattggaccgttttaagctggatgatgtgactgatgaatacttgatgtccatgtatgggtttccacggcagttcatttattacttggtggagctcttgggggcgaatctttctaggcctactcagcgatccagggctattagcccagagacacaggtccttgcagcattgggtttttatacctcaggttccttccagactcggatgggagatgccattggaatcagtcaggcgtctatgagtcgttgtgttgccaatgtcactgaagcacttgtggaaagggcctcacagttcattcgctttccagctgatgaagcctccattcaggctctgaaggatgaattctatgggttggcagggatgccaggggtgatgggggtggttgactgtatccatgtggccatcaaggcaccaaatgctgaagacctctcctatgtgaaccgaaaaggcctgcattctttaaactgcctgatggtgtgtgacattagagggacactaatgaccgtggagacaaactggcccggcagcctacaggactgtgctgtgctgcagcagtcttccctcagtagtcagtttgaagcgggtatgcacaaagatagctggcttctgggtgacagttccttctttcttcgaacctggctcatgaccccacttcacattcctgaaactccagcagaatatcgctataacatggcccattctgcaactcacagtgtgattgagaagactttccgaaccctctgctcccgattccgctgcctggatggatccaagggggcactgcagtactcaccagagaaatccagccatatcatcttggcctgttgtgtcctccacaacatctccctggagcatgggatggatgtttggtcctctccaatgacaggacccatggaacagcccccggaagaggagtatgagcacatggagtccctggacttagaggctgaccgtattcgtcaggagctaatgctcactcattttagctaatgtagaaggtggagaggagggatacttcccaggagttgtgacagactttcctcctcatcaccttttacacagttccatcatctagcatgactgagtatacagatacttgtcataaactgacatttaatatgtgtgttttggtaaggttggggctatgccagaatatcttgattcatttgcatatgcattaattaaactgaaaccaagacagcggctccctactatccagtgaactctaggttgagtaccactaatttgaaagctcagtggttgcaaacatttatgactgtgcctacaaagtcatagtaaaggtcaggagttcaagacaagaccagcctggccaacatggtgaaaccccgtctctactaaaaatacaaaaattagcggccgggtgcggtggctcacgcctgtaatcccagcactttgggaggccgaggcgggcggatcacctgagttcaggagttaagaccagcctgggcaacatggcaagaccctgtctctactaaaaatacaaaaaattagctgggcgtggtgacaggtgcctgtaatcccagctactcggtaggctgaggcaggagaatcacttgaatcagggaggcggaggttgtggtgagccgagatcgtgccattgcactccagcctaggcaagaagagcgaaactccgtctc

SEQ ID NO: 1362 - DNA, 1768 bp, Homo sapiens
aaaaagactagggcgccagcggctggcgaagaaggaaagagggtactctctggctgggctggggccgtagcgacgtccgccgcgaacctgggccccccaaagctgcggggcgttcggtgtcgccgaagtaaacatgcaccctgagccctcggagcctgcgacaggtggtgcagcagagctggattgcgcgcaggagcccggcgtggaggagtctgcgggtgaccacgggagcgcaggccgagggggctgcaaggaagaaattaatgatcctaaggaaatatgtgtgggttcttctgacacatcctaccacagccagcagaaacagagtggtgataatgggtcaggtggtcacttcgcacacccaagagaagacagggaagatcggggccccagaatgactaaaagttccctgcaaaaactctgcaagcagcacaagctttatattaccccagcattgaatgatacgctgtatttacactttaaaggttttgatcgcattgagaacctggaagagtacacagggctgcgctgtctctggctgcagagcaatggaatacagaaaatcgaaaacctggaggcccaaactgagttgcgttgcctcttcttgcaaatgaacttgctccgtaaaattgagaacctggaacctctgcagaaactggatgctcttaacctcagcaacaattacatcaagaccattgaaaacctctcctgcctcccagtcctgaacacattgcagatggcccacaatcacctggagaccgtggaggacattcagcatctacaagagtgtttgaggctttgtgtccttgacctttcgcacaacaagctgagtgacccggagatcctgagcattctggaaagcatgcccgatttgcgtgtactgaatttgatgggaaacccggttatcagacagattcctaattacagaaggacagtcactgtacgactaaagcacttaacatacctggatgatagaccagtgtttccaaaggacagagcttgtgcggaggcctgggctaggggagggtacgcagctgaaaaggaggagagacagcagtgggagagcagggagcggaagaagatcacagacagcattgaagccttggccatgatcaagcagcgggcagaggagaggaaaagacagagagagagtcaagagagaggggagatgacatcttcagatgatggtgagaatgtgcccgccagtgcggaaggcaaggaggagcctcccggggacagagaaacaaggcagaagatggagctatttgttaaggaaagctttgaggccaaggacgagctctgcccggaaaagccaagtggagaggagccgcctgtggaggctaaaagagaggatggagaccctgctactgtcaccgcctgcgaaggttaaaggagaggatggagatcgagagccagaggggaccctcccagctgaggccccaccaccaccgcccctgggagctgccagggaagaaccgactccccaggctgtggccactgagggtgtattcgttacagaacttgatggaacgagaacggaagatttagaaaccattagactggagacaaaggagacattctgcattgatgacctacctgacttggaagatgatgatgaaacaggcaaatctctggaagaccaggttaaggtcattagaaaccattttcccacaggcagcttaattccaccttcgttcttgtcgtttaccgtttctctcctaaacttgaaagtaaaatgttccctgtgcataaagcattgaattccccc

SEQ ID NO: 1363 - DNA, 2128 bp, Homo sapiens
agatgacgaggaggcaccagcaaaagagactgagaaagagtgggcaggcaaatggaagaaagaccgggcacaatgaagggcaggattagagtgcaggggccagccatgccctcccgggagactggcccctagcgctgccggagggcagagagtggcacatggctcagcctttggcactcaggtgaggaaactgagcctgagaccgaacaaggatgaggaaacttgaggctcagaatggttaattacctcgcctaaggttactgattaataaatcactgagtagagactgaaacccacatctgtctaccagcaaaggctgtccatactacaccatgttatctccaaatgaaacctcatatgaagttgctgcagaaactctatgggaaaaaaagacttttagatcttctggaactacaacatctagtctccgtgaatctgcaccatctcttagcactgggtcctgggaggagggggtgcttccaccagctccctccccttcttcctgccatgttcctacttcctaagaagcaaagacaaacttgagttaggatcaacatgaggagcccacagtgggttaatgtgacagatgcatctccctgggtggcagagtgggcttcttgtggggtggcagtcactgaagtatgcttccaactcgagagtcctggacatgtgtggacacgacagtgtgctgaccacgagtgaatgtataggcaagtcttcctggaaaacaggccatatttctcactgaggctccctggagtggctggtggtcacagcacccaccacttggacactttgtcctgctgatactaataatagcaaatagcattatcatctggcaggcgctcttctaagtgctttacaaatgttgacttgtgtaatcctcacagcagcactatgaggtagggactatcattaatcctgttttataaaggaagaaactgagcagatagcctttaagtaactaccccaaagtcagaacagaggagcccttctcaacacatcagagacacttaggggtgcagcaattcacactgctcaaacagccttacaaatactaactgatgtgtgaaaaggattggagtgtgttcacagaccccagcatctcagagctggaagttgttttagagaccctcagattcagacccttcgtcttatgcacaaactccagccgaaagagggacggtaactcagtcaacaacagcactgatgcttttgggagatgcctgcagctgtttcccatgctcctggcttggcacaaaggcctgccctccctgagtctcccagggatctgctgttaccccaggagcgcccaccagcaagctcaccagtccagggagagcccagcacttttccacattcaggtgttcatcgccctaatcgtttctgagggaggaaggtgaacccaaggtagaaagtccccgcaacgaccaaagctggtctgtgcactgtggaggtccaggaccagctacggacaaagagcagccatgaattcctgcactagaaggacaactccttgaggacagggatgctcttcatctgagcccaggatctgccaccaagccatcctccaaagatgttggttatacaactacaagctaagtcaaagaggatcggagcccaaacagagaagacagctgtgggtgtcagaggagaaaagactgaaagggaagctggaaagaaaggaatggggagaaaaccaggaaaaaggatggagagagagagctcagagctgaggaaagctgcacaaaaatgcaagatctggaaacagatggaaagaattgtgaaaagcagaactgggcacacatcctttaaaattcagcctttaaagaggatctactccaaaccccgcctctatggggaggaaaatgaaggtccatgtggggaaacgcttgccaagataatatgcagggagttaatggcagacctaggataagagtctgatagagtcagacaaggccaagtttgatttctggctataagctgtgtgatattgggcaagttagtttctcactctgagctatggtttcctcatcaatgaagatggggttaatcgtgtctctatctcatagccttattgtaagaattaaatgagatgctgtaaataaagttgcctacatgtgcctgc

SEQ ID NO: 1364 - DNA, 2803 bp, Homo sapiens
tttgctgatgtggccccaagcccgcctccctccccaccctgcgatggcagaagaaactcgacaaagtaaattggcagcagccaagagaaagttaaaagaatattggcagagaaacagccctggtgttccagcaggagccaagaggaacaggaaaacaaatggcagcatccatgagacagccacttctggtggttgccactcacctggagattcagcaacaggtatccacggggagagccctacatcatctgctaccctgaaggatctggagagcccgtgccaagaactagcagtagtcccagactcgaggtccgtaaaagtcagtcaactgaagaacaccatcaaatctttgaaacaacagaataaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggttcaaatccagagattgaacatacagaaagggaaactaaatacggacctgtaccacacgaaacgttctctcagatactttgaagaagagtccaaggatctggccgtccgtctgcaacattcattgcagcgtaaaggagagttagagcgggctctctctgctgtcaccgccacacagaagaagaaggcggagaggcagttctccagccgcagtaaagcacgtatggagtggaagttagagcagtccatgcgggagcaggcactgctgaaagcgcagctgacacagttgaaggagtcacttaaagaagtccagctagagagggatgaatatgctgaacatctaaaaggagagagggcccggtggcagcagaggatgagaaaaatgtcgcaggaggtttgctcgttgaagaaggagaagaagcatgataaatatcgggtagagaagctggagaggagcttgtccaaactcaaacaccagatggctggacctctgcccccggagcccccagcagtgccctctgaggtggagctgcagcacctgaggaaggaactagagagagtggcaggagagctccaggcccaggtggagaaagaagaacttggattcttccagtactacagagagagatgccatcagaaagtttatcaccctataacaaagccagggggctgtgccaaagatgcagcaccgggaggaggacaccatcaggctggccctggacagggaggagatgaaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtgatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctgaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcataattgtaggtcattagcatgcatattgagtttgcccttacgtggtgggagttcaaacacacaaagacccactatttgcacaaaactattcttgctggtttggaataggctgccatgtgtttttaatgttattgcagcatgtatattcattacagaattcagataaaatgtgcctatgttctgctgttgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagcttcagcagttgtactcttttttgatgacctaaaaagggcttatttctgaggaatgaaaggttcccatcattgactacggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctt

SEQ ID NO: 1365 - DNA, 1996 bp, Homo sapiens
aagagatagatctgggatttaaactccagcagtctggttccaagatagttgaaacctaagagaaggctacatagttgaatatggtggtgccgctgtagtcccagagactcaggaggctgtggcaggaggattggttgagcccaggaatttgaggttacagtgagctatgatcatgccactgcactgcagcctgggtgacacagtgagacactgttgaaagaaagaaagaaagaatgagagagagagagagaaagagagggagaaagaaaaagaaaagagagaaagaaaaaggaagaaagaaagaaggaaagaaagaacgaaagaaagaaaaaggacgaacaaacgaatgggagagagagagacagaaagagagaaggagagaaagaaagaaaacaaaggagaaagaaagaggccaggcatggtggctcacacctgtaatcccagcactttgggaggctgaggtgggcggatcaggagttcaaaaccagcctggccaacatggtgaaactccatgtctattaaaactacaaaaattagctgggcgtggtggtgggcgccagtaatcccagcacttggtactcgggaggctgaggcaggagaaagagccgagagagagagagaggagagagagagagagagaaggcagaggggcaaggggagagagagacagagagaaggctacagagaaacatggggattcagcacaagctgaagagacctcaggaaggctgctgcacatctgggcggaggagagcaggagtaggagcccagcctcaggcgtgttgagatggaagagcatgtcctgatgggagacactgccactgctagcggctgcctgccccttgtccctccctgagctgagccatgcagtcagctgaccctgccatgaagaggctgtgaggagcctcaccagggatgagctccgagggccagaggtgaggatgatgctgatataggagtgaaggtgtctcaacctgtcccgggccacagccttgccaccctggtgagtggcatggcccgggtgtgactgatgtgaccaaatggatttactccactggggaagggctcctgggtttgcctccctccacagcactgcctgggagcaccagcataaaagcaaggccaggcgcctggaagagcggggagagagtggtggccacagtgtgtcagagccttgggaccgagaagcaaaagtgaggagaggagacacaggaccagggagatgctctccctgctcagtgggctggctttactggccatctccttcctgctcctgaaacttggcaccttctgctgggacaggagctgtcttcctcctggcccactccccttccccatccttggaaacctgtggcagctatgctttcagctgcacccagagacactgctccaggtaggaagcctgtgctcaagctggaggccctaaaggggtggacagatgaacccctcttctctctcagaccagcggcactggagacagaaagaaggaacagaggtcagacacgtgtggggtgaatcctggtcttaccattcattagctgggaggctttgagcctcagtttcctcgcctgtcaaatgcagggtgggagggggattgcagaaattgtggacttcgtgcagaatctaagaagtctaatctaagaaattctgagtgcaggagaagtccactgccaatggaacagggtggcgaaaaccactgaacagagctcaactccaggagagcactgtgtgtggctggaagaagttttctgaaaagccacttgagatgggagttggggggaatgggacccccacaagggcacattcaagtgacgttactcaaggaatctgtgcacaaagccaccaccagggtagctggagcctcagctgaagggcgctgttggattgagtgggtgggactggggtgctgctgagaatgattgtgggcaggacactgtctttcctaaggccatgttcagccctcttcttattcacactcaacacatttttaaaaaat

SEQ ID NO: 1366 - DNA, 2403 bp, Homo sapiens
cacaaacgccggggcctgagatcgcggtggatgcacgcgcgggagcctggcttggctgttattgttgaaaactctcttggcttggactcagtttaccccctgacattgataataaagtgacgttggctgctgcagaaggagttcaccacctacgacttccccagcatgtctgctgaaaataatcagttatcaggagcatcacctcctcaccctcccacaactccccaatattccacacagaacttgccttcagagaaagaggatactgaagtagaactagatgaggaaagtctacaggatgaatctccattttctccagagggagagtctctggaggacaaagagtatctggaggaggaagaggatctggaagaggaagagtatctggggaaagaagaatacttgaaggaggaagagtatctggggaaggaagagcatctggaggaggaagagtatctggagaaggtagggtatctggaggaggaagagtatattgaagaggaagagtatctggggaaggaagggtatctggaggaggaagagtacctggggaaggaagagcatctggggaaggaagggtatctggagaaggaagattatattgaggaggtagattatctggggaagaaagcgtatctggaggaggaggagtatctggggaagaaatcatatctagaaaaggaaaaggctctggagaaggaagagaatctggaggaggaagaagctctggagaaggaagagaatctggatggaaaagaaaatctgtataaaaagtatctgaaagaacccaaggcaagttattcatcacaaaccatgcttcttcgtgatgcaaggagtccagacgctggcccctctcaggtgaccaccttcttgactgtcccgttgactttcgctaccccttctcctgtctctgaatctgccacagagtcttctgagttgcttctgacattgtacaggaggagccaggccagtcagacagactggtgctacgacagaactgccgtaaaatctttaaaatcgaaatcagaaacagagcaagaaaccaccacgaagctggctccggaagagcatgttaacactaaagtacagcaaaaaaaggaagaaaatgtcctggagtttgcttctaaagagaacttttgggatggtataacagatgagtccattgacaagctggaagtggaagatttagatgaaaactttttgaacagctcctatcagacagtatttaaaacaataatcaaagaaatggctgctcacaatgaactggaagaggattttgacattcccctaactaagctactggaaagtgaaaacagatggaaactggtaattatgctgaagaaaaattatgaaaagttcaaggaaacaatcttacggattaagaggagacgtgaagctcaaaagttaacagagatgaccagtttcacatttcatttaatgagcaaaccaacacctgagaagcctgagacagaagaaatccaaaagcctcaacgtgttgttcatcataggaagaaattagaacgagataaggaatggatacagaagaagacagtggtgcatcaaggtgatggaaaattaattctctaccccaacaagaatgtctatcaaattctctttcctgatgggacaggccagatacattatccatcaggaaacctggctatgctcatcttatatgcgaaaatgaaaaagttcacatacatcattctggaagacagtctagaagggaggatccgggcccttatcaacaactcaggcaatgctaccttctatgatgaaaatagtgatatctggttgaacctgagctccaacctgggctactacttccccaaagacaaacgccagaaggcctggaactggtggaatctgaacatccatgtccacgcaccccctgtccagcccatctccttgaaaatcaatgagtacatccaggtacaaataaggagccaggataagatcatcttctgcttcacctatgaacagaagcagatttgtttaaacctgggcaccaggtacaagtttgtgatcccagaggtgctgagcgaaatgaagaagaaaaccatcctggaggcagaacccggcccaacagcccagaagatccgggtccttctggggaaaatgaataggctcctgaattacgcgaccacccctgatctggaaaacttcatagaggccgtcagtatatcactgatggacaacaagtacctgaagaagatgctctctaaactctggttttaaggcggggcttatctggcatccaccaaatgccttaggaagttggagaccttgggagctccagggaaaaaaaacccaaagacctgttgaccttttatgagagttggtttgtaatttgggacctgtcgtggctccttgatttgaagtaaacatttttggcagaagggc

SEQ ID NO: 1367 - DNA, 1703 bp, Homo sapiens
attcgggaccctgcactccgtcgccggaagtgccaccgaggagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggtgagctgaggaaccctctgcttttcctcagggactattgctactgatggagtgtggcctctctctcatcccatctgtagaccttgcctggaatttttttcaatagcagactccagtttgggaattgatcctcttcggagacctggacttcacataaaccaacttcccatctccccagtgccatgagcaaactctgttttctctttgtccatggttgtgtgatgggtgcttattagatgtttaagggttatgggctttattccgtaggttctaatctgttctccctcctcctcaacgtaagtacacagtggataccctctctatgatcttcattctctggccatggtgctacagtgttctcattcctcagagcagccaggatgtgttatttcaggagtttgtgacattcgaggatgtggctgtgcaccttactcgagaggaatggggatacctggaccctgttcagagggacctctacagagaagtgatgttagagaattatgggaacgtggtctcactgggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagtt

SEQ ID NO: 1368 - DNA, 2043 bp, Homo sapiens
agaaataatgtatggagggactacacaagggcatatatactagtaaaagtgttttctcaatagatcaccaaagaatttgccacacctgatatatagaaaagtttattgtgcagcacctctaccttcgctctcctgctcctgctctggccacataaaacgtgctggctcctcctttgccttctgctatcattggaagcttcctgatgcctcccaagaagcaaatgccatcatggttcctgtacagcctgcagaaccccccgaggtactgaagagtgagccgtatggggagaaggctgatgtctgggcagtaggctgcatcctttatcagatggcgactttgagtccccccttctacagcactaacatgctgtccttggctacaaaaatagtggaggcggtatatgaaccagtgccagaaggtatctactctgaaaaagtaacagacaccatcagcaggtgcctcactcctgatgcggaagctcgtccagatattgtagaagtcagttcgatgatatcagatgtcatgatgaaatatttagacaacttatctacatcccagttgtccttggaaaagaagctagaacgggaacgaagacgcacacaaaggtattttatggaagccaaccggaacaccgtcacatgtcaccatgagctggctgttctatctcacgagacctttgagaaggcaagtttgagtagcagcagcagtggagcagccagcctgaaaagtgaactttcagaaagcgcagacctgccccctgaaggcttccaggcctcctatggtaaagacgaagacagggcctgtgacgaaatcctgtcagatgataacttcaacctggaaaatgctgagaaagatacatattcagaggtagatgatgaattggacatttcggataactccagcagctccagttcaagccctctgaaagaatctacattcaacattttaaagagaagttttagtgcttcaggaggagaaagacaatcccaaacaagggacttcactggaggaacaggatcaagaccaagaccagctttgctgcctcttgacctgcttctgaaagtgccaccccatatgctcagggcccacattaaggaaatagaggctgagttagtgacagggtggcagtcccatagccttcctgctgtgattcttcgaaatctcaaagatcatgggccacagatgggcacattcttgtggcaagcatcagcaggaattgctgtgtcccagaggaaagtgcgtcagatcagtgatcctattcagcagatattaattcagctgcacaaaataatctatatcacacagcttcctccagctttgcaccacaatttgaaaagaagggttatagagagattcaagaaatccctcttcagccagcagagtaacccttgtaatttgaaatctgaaattaaaaagttatctcagggatctccagaaccgattgagcccaactttttcacagcagattaccatttattacatcgttcatccggtggaaacagcctgtccccaaatgaccctacaggtttaccaaccagcattgaattggaggaaggaataacatatgaacagatgcagactgtgattgaagaagtccttgaggaaagtggctattacaattttacatctaacaggtatcattcctatccatgggggaccaagaatcacccaaccaaaagatgaaaatgctgcattttgagtggacttgattttctcagtgaagttcaagttctggacttcagccgctattgcaagatgcccaaggattgggtgctgctagagggtgtggaaaagaccaagatgccatggggcctgcaggacttctttctgggggtcctgtgctggagtatatgacagctgcggtacttgagggcttcattgccagaacacattatatacaggatgtcagagctaccagtgtgctgctgggagaaaatgctgcaaaattcatcttttggagggtggggggaaaacccaaaaacaacaacaaaaaaactctcttacagaattttccttaacattaaaaaaaacttgtcatattt

SEQ ID NO: 1369 - DNA, 2516 bp, Homo sapiens
agaacagctggaatccttcgcccccggcgcgcagccttcgcccgccggaatcgctgccttatccaccagcgggatgcttgcctcgcccgccctctcgggtcaggcgggcccgggaggatgggagggtggctgctgagcgggagccgccacgtcttccacccgacatattgcctagagtttgctgtgacttagatcttgattcagagatggagaaatcaggcccatcttctaccatctctgagcagcagctgcagaggcaagagggatggattaacaccaaaacagacttggctgagcagagtctcatttcatctgagaaatggcttcaactgcatgggcttaagagcaacaaattgaccttgaaacagattttgtcacagatcggattcccacattgtgaagattatgtggcgtctctggggagacctgtggcttctcggtatgctgatggtctgtttccacagctctacagagcagaagatggcagagtatacaatctgacagctaaatcagaactgatttatcagtttgtggaacatttaacacaagctgtggagagctacaagcagcgaatggactggctcaccagcaagagccggcagatttttggtgtcatcttggaacagtgcgtcaccatagtgctggattttggcggcattctggagggggagcttgatctgtgccgagaggctctaacaatggttctccaggagcaggtggctcacataaccgagttcaatatcatacgggtttctcaagagcctgtgaagtggcaggaaaatgctactcctgtgaccgaacagtccatagctactgccatcagttgggttgagaaactgacggttgagctgactgtgagcgaggctggccgcctggatgctctgctggaagccgggagagacaagactgagctggagtcagagaggacgtgtttctcgtttggcaagagatggaggaagcctgcagcacgctggcccagatccagaggctggtggccgagcctcctaagcccgacgtggccactgtggactgcgagtcagaaacaacctctgttgagattgcatcgaatccagaagacacctgggactctaagacatggctgcagaaatatggcttgaaggcccagaagctatccttgtatgatgtgcttgccgactgctctttccgccacgctgatggggttgtggatataaaagccaaaccggagaatgagtccgtgcagaccagtgcggattaaatggctacaggatgggagtcaaagcctctttggaagattgcataatgattgcatctacattctcattgacacgtctcactcaatgaagagcaaactggacttggtgaaggacaagatcattcagttcatacaggaacagctgaaatataaaagtaagtttaactttgtgaagtttgatggtcaagcagttgcttggcgggaacaacttgctgaagtcaatgaagataatttggaacaggctcagtcctggattagagacataaagattggaagctccacaaacaccctgagtgccctgaaaactgcttttgctgataaagaaacacaggcaatctaccttctgaccgatgggagacctgatcagccacctgaaacagttatagaccaggtcaaacgttttcaggaaattcctatttataccatctccttcaattacaatgatgagattgcaaacaggtttttgaaagaggttgctgctttgactggaggagagttccatttttataattttggttgcaaggatcccactcccccagaggctgttcagaatgaagatctgactcttttagttaaggaaatggaacagggtcacagtgatctggagaagatgcaagacctttattctgagtccttgatcatggactggtggtacaatgcagaaaaggatggagacagcaagcatcaaaaggaaatctgttctatgatttcaaccccagaaaagtgtgcaaagcctcaatctgatgtcgattcaacacaaacttcatctctgaatatgttgaagggaccatggggcctttcagatcaaaaggttcagaaaaagaaagtccttcacgcagaatcaaccaaaaccagcctgctcagaagccagatgtcctccctcaggagctcagcttgcagtgaaaggaaggatggcctctccaatgccagcagccggaggactgctctaagtgacaaagaaatgagcatcttgctggctgaggagtggctggatgacaaatcgtcagaaaaggtgacgcgagaaggaagccaggtttatgaccacgattcttcagatgtgtcttcagaaaactggctgaagacctatggcttggtcgccaagaaactcaccctcatggatgccttgtcagtggcagcagtcccgcacagctccacctatgttcccgtcctggacaagcatgtcgtgtctaaggtctttgatgaggtaaactgattgtctatacgtccctacttgaggccattttcattttctgctcaaataaaaagtagtccaatttcttgt

SEQ ID NO: 1370 - DNA, 1962 bp, Homo sapiens
gtcagccactgggcagcccggggcactcctgcagcgtcccctggccctctccagggcaggggaaggttgggcagtcctgggcggccagcaccccggcgtgcatgtctcctgagcagctgcccatcgggcctctgctggcctgggggctccaagatgcaaggccggcgggagctggggggagagcctttgagtgacctccaggaggaagcagccagcgcttccctccgagtggcacctgagaggctgagtgatgacagtttggaatggagacggacctgccccgaccttctcctgtccgatgggaaagccagcatctccatgccccgtgagggcggttccacctgcactgcccgatgtcctgaccctggggaacacagcagcacttggggggagtttgaaggctttcgggaatcttcagccaagtctggacaattctcacagtcccttgaactcctcgagggacccacagaaccccagccaccgagaaccacttctgccccaaaagagtgcagttctcaccaaccatgccagggtggaccttgggtgacaggaacttctgccgtcccaccttctgagcccattctcagctatgagaacattttaaagtgtgcttttcaagaaataacagtccagcaggcagctgaagacgtttccaccatagaccatttcctagaaataagcagtgaagaaaaacctggcgttgaacgtgtacataaattgtgggacacactttcaactgagcattgaaagacagacagcgctcgagtggattaggccgcggtggttgagaagctcgagtaacgaatccagaaaactctggagagcccttcagagcatacacaccacgtctacttctcagcgcctctggagcgagtcccgttgccaggagaacttctttcttgttctcggaatagatgctgcgcagaagaacctttctggaggccagggccacatcatggaagattgtgacctcaaagagcctgaaggactcctcactgtcagcagcttctgtctccagcattgcaaagccctgatccagaccaagctctcggggccgcctggcagcaaacaggggaggctgatgacatgcagccgcttcctgaagaccccctcatgcggaggtggccagcacatcactattccaaggaaaaggatgttcactccacgcaagctcaaattgacactctttaatagcgacgtttgctaaaatcaggaggactttgtacctttatgaggaatttttcattttcttcctggctgggttgatgtggaaaccagagctgtctgtggagctgttttccagaccccaggcccattcctgggatctctccaacaggacctgtcctgtgttctgggcttgtctcgggtctgaccaggagatggaggatgtgtccttggcagagccaaggggagacagaggtttctggatgccatgacaggctgtcggggtccaggtggcactcatgggccccctgccccatgtgaatgctgctggcacctggtggggggttgcccagggatggaccctgggcatggcttctgggctgcttagtccagggggagcaacttgtggccaaatccatgagttcagaggaaaaggggaaggcactgaaacgtcaccagagagacagctgttgagaccgctcagaaaccctctgtctgtcacactctgccctggctgctgtgtggtcagggcaccatgagggtgtacagatgtgctgtgtcctcagagcctcgcaggtgccctcacttactgcctgggcccctgcccagcagcctcaaggacaggcctttgtccctcacggttgtggacaggaggtcgcaccactggcctgcgagagcctctggtgggcccgtggcttcccccagttatctgctaaggaaaactgtgctcttcgaagggcagagccaagaagtcagccctgacttttgtaaaattttactaaataaaaccacctggat

SEQ ID NO: 1371 - DNA, 2167 bp, Homo sapiens
ctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaaaagtgtgatgaagaccacatggggtgtgctggatcctcctgtggggaatacccggttgaatgtcattaggttgatatccagcctgcttcaaaccaataccagcagtataaatggggaccttatggagctgaatagcattggagtcatattgaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaagtgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagttacaacctgccatattcattcatccagtgatgatgaaattgactttaaagaaacgggtttctcacaggattcttctttgcagcaagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaag

SEQ ID NO: 1372 - DNA, 1937 bp, Homo sapiens
agtgaagaatttggcgccatcttgagaaggtcaaagtgattcttcgattaaatgccttacttatcgcctagtgtgacctggcgcttgggtttactctccccagcaactgcgcctcaaacgcaaagaaaactgcaggtcctcggggaaggatcgatttcaccattcaagagaaaaatccatttcccagattcctcccctttatgtaaacgtctggtacctagtagacgttaaatacacgtgagttttccggttttataagatcacatactgcaaaccaacagtaaattacattaatacgcatttctttagaaattcttaattgctaggcactgacatataaattgagtttgctgttgttttagagagaaaaatagacatattcattttttttcaatcaggacatggtattcgtttccttcttaagcttcccatttttgaggtaggaaagtattggtgtgtgtctctatctctaccttgctccctcattagcaggcttaatgggcaggaattatgtctgttttgctttccgttggatccccgggtctagtagagcgccttgacacatagtaggtactcgacacagatgctggcttcatgatgaagcaattgtcctcgaattaatacaaaagggaagattcagactcagcgagccggtaccattcgtctagggacacacagccaggaaggaaccgaaccaggattctaacccaggattacccaagttcgaattctaattgaacataagtccttagcgaccttggacggacttactaaactgccctgaatctcggcttccttagctgcaaaatagggttaggaaaagtggactcggtgctcctctgcgccgcattcccgcagcgggatttgtgaaagcgaacttgagccccacactgcagaagccctgaggtcctgtctcaaccagaatccagcacccaggacaagccctccagcgacttcagaccttcccgctcccgaccccgcccgcccccgagaggcgtggtcaaggcggggccagaaggcggacgcgtgcacggagcggtaaagcgcaggcgcaaagcttcggtgacgtcagagaggcgcgctcccagctcggagccgactcgcagacgcgccccgcccctcggcgtcgctctggactggcgcaggcgcaagccggcaagatggcggcggctggggctttccgtctgaggcgggcggcatcggctctgctgctgcggagcccccgcctgcccgcccgggagctgtcggccccggcccgactctatcacaagaaggttgttgatcattatgaaaatcctagaaacgtggggtcccttgacaagacatctaaaaatgttggaactggactggtgggggctccagcatgtggtgacgtaatgaaattacagattcaagtggatgaaaaggggaagattgtggatgctaggtttaaaacatttggctgtggttccgcaattgcctccagctcattagccactgaatgggtgaaaggaaagacggtggaggaagccttgactatcaaaaacacagatatcgccaaggagctctgccttcctcccgtgaaactgcactgctccaggaaagaaggaatgagaaacattagccttaatgcatcgatggaggtttactaaccaaattagttaaaaatcagcagagagtcaggcctcttgccaagtgctggctgaagatgcaatcaaggccgccctggctgattacaaattgaaacaagaacccaaaaaaggagaggcagagtagaaatgagccctccctcggcgaagcctccagcaggccacaccagctgtttcccacctgctgtgcagtcaccttagatgttcagaagccgcttcctctccactgaagagctatgagatacgcacaatacttgctgttcacgttatgactctcatgcaagcaaaatatacagtttcattgttctg

SEQ ID NO: 1373 - DNA, 2698 bp, Homo sapiens
acgtgctgtacagcggctggctgaggaagtcgccccccgagaagaagctgaggctctttgcctggaggaaacgctggtttatcctgcggaggggccagactagcagtgacccagatgttctggaatactacaagaatgatggctccaagaagcccctgcgcaccatcaacctgaacctctgtgagcagctggatgttgatgtgactctgaacttcaacaagaaggagattcagaagggctatatgtttgacatcaagaccagtgagcgtaccttttacctggtggctgagaccagggaggacatgaatgagtgggtccagagcatctgtcagatctgtggcttcaggcaggaggaaagcacagctgagcccagctgctcccatcagcacctcccccaagaacaagaacccacatctgagcccccggtgtctcactgtgtgccgcccacctggcccatccctgcacctccggggtgtctccgctcgcaccagcacgccagccagagagcagaacatgcaagcttcctccggcaagtacacccagcatggtggagggaatgccagccggcctgctgagtccatgcatgagggagtctgttctttcctgggccaagacatctgatgtgatccttgccttgatcagggcctgagatgctgacctgccagtgccgagtcaggacttgaggtggatgatgggtctcgaggccacatctgcatggtgcatggtctgtgctgccttctgcctgggtctggtatccagaaacctgagtggacattgggtgctgagccacatctgcatggtgcatggcctgtgctgccttctgcctggctccggtatccggaaacccacgtggacattgggtgctgagccacacctgcatggtgcacggcctgtgctgccttctgcctgggcccagcatccagaaacctgagtggacccagccactaaagatattttatcccatagatttgtcacaaattgtagttggaccccaaggggtcctgagagctagaagtgcccagacatctcatttttttcttgcctctactttgatttcagagtctttccaaggtcactctgatagcttcaaagtgtagccctccccatgtagtgaactcttataattgtatgctgccttggcatccacatcgaatggagttttaactttctcagaccagaggcagaggacttagtctccctgatggtttccagttctacaccacacccatgtggcttcagtcagtggccagagatgggaatttagacttacctcccccatgcagcagactgggctcgccactttcttgctgctccctttaaatggaccatccaggcatttactctgaccttaattaagtgatcccacaccccattctgcaagatacacttccagttgccaccctctctcctcttactccctaacctcccaggacctgtaagaactgaaaactcttccacttttacatgttgactgtgtcatggaagctgctccaaagtctgacccctgaggctgcccagaggggccccatccatggggtttctggctggggcacttctatctgggccgcaggtggctgctgaagacagcagcccccagccaaggtgatcaaaagtttcgttcaaaacaccccgtcatgactctttttggccttgtctagaaattctcattcctatcttgttcttgctggtgatagctgtgtttctttcactgtcctcttcctagccaggaagaacgcttgtgggcctgtcagacagcattgcttctgagggcagctgtgtgcccatgaacccaggctcccctaccctgccggctgtgaagcaagcaggcgatgattcccagggtgtctgcatccctgtgggctcatgtcttgttcgctttgacctgcttggctccccactcacagagctttctatgcaccaagacctcagccagggacatgaggtccagctgccccctgtcaaccgcagcctcaagcctaaccagaaagccaacccaacaccgcccaacctgagaaacaacagggtcatcaatgagctctccttcaagccacctgtcacagagccctggtctgggaccagccacacctttgactccagctcctcccaacaccccatctccacgcagagcatcaccaacacagactcagaagacagtggagagaggtatcttttcccgaacccggcatctgcatttcctgtttccggtggcaccagcagttcagctccgccgaggagcactggtaacatccactacgcggccctggacttccagccgagcaagccatccataggctctgtcacgtccggcaagaaggtggactatgtccaggtggatctggagaagacccaggccctgcagaagaccatgcatgaacagatgtgcctgcggcagtcctcagagcctcccaggggcgccaagctgtgactcgggccaccaaaaccagagtggggccaggacagtgcctcagagctgctccgccacactctaaagctctgtaatatcagggaccgcatcccttacatagagagcagaggcctgatcaatatacatcctttgcctgcttggggcccacctgtgcctttggctggccatggtccccaccttcacccccttgctaggagcagttgccggcaagcatcctcagtctcttcctgcccctcagacctgggctcccaatagatttccactctcacactt

SEQ ID NO: 1374 - DNA, 3037 bp, Homo sapiens
ttttttttgagatggagtgtcactctgtcgcccaggctggagtgcggtggtgtgatcttggctcactgcaacctccacctcccgggttcaagcagttctctgcctcagtctcccgagtagctgggattacaggcgcctgccaccatacctggctaatttttgtatttttagtagagatggggtttcaccgtattggccaggctggtcttgatctcctgacctcgtgatccacctgcctcggcttcccaaagtgctgggattataggcatgaggcaccgtgcctggcctaatacgaattcttaataagcacaataacggtatatccctcccctttcctctcagtgttgttgttggcagctgtggctaaggaggggagaacctctgctccccgcccgtcttctcttctgcgtttcccgggctagggggcgtggggagtggttttaggcggcgaagccgctcggcagcaccttccttctttgccgggcagacgcccgttgtagccgttggggaaccgttgagaatccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactctttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttcttttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagagtccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttctctctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagttttatggaaacttggtatagcagctaaaagagtttagtttgtttatatggcatgtataagttttcaataaatgcctaaagttcaagcat

SEQ ID NO: 1375 - DNA, 1690 bp, Homo sapiens
aaaagccctaggagaagtcatcaccactttgtccaccatgggtgaattatgaatcagtagctatgccaggcctcagctgggccacatctggagaactggggtgagggcacaacatcacaaaatatctggccccagtctggtcactcatcccttttagggcaacaaggaaactatcctgtggcctgagagcacaatacctgagacaaaggccagcagaaacatttgtctgccctcaccctttctgccccagcttccacctgctccccatctgcccacccactaaagcccatgtggcatgccatctctcgaacatccaggatgtcccagagtggatgtccatcaggtctgctggcagacaaaaatatctcttcaagtgccactcgagtgatagtgaagactgcaggcaaccagaaagactttatggtagctgatgacatctcggtaaggcagttcaaggagatgctattggctcacttccaatgccagatggaccaactagtgctggtcttcatgggttgccttctcaaagaccatgacacactgagccagaggggcatcatggatggccacaccatctacttggtcatcaagtccaagcagggctccagatctctagcccattccttccgggacctgccaacgaatgatccctgccaccgggacagaaacacctcagccaatgacacccttaacgaggtcaaccacacttccaaagccaacactgctatgatttccaccaagggccagagccatatctgtgccactcggcagccagctgggataccagccttacctagcatagagcttacccagcagcttcaagaagaatacaagggtgccactgtttctctaagtagctccagacagacattaaagggtgatctccagctgtcagatgagcagagcagctcccagatcacaggaggcatgatgcagttgcttatgaacaacccctacctggcagctcagattatgttgttcacaagtatgccccagctgagtgaacagtggaggcagcagctgcccacattcctgcagcagacacagatttctgatctgcttagtgcttaggcaaccctaaagcattccaagcaatattgcagattgagcaggccctccagctgctggccacagaggctcctgttcttctgccttgggttgcaccctacctatggggcctgggttggcttcctgcccccagctgcagctatcctgacacagtgccctgttcctggaatgtttcagatacagctgagcccaagggacctgagtgctgccacaagcctggaacagtcctgcagaggctacaatccccggatggggacccttcccaccctctgcaagctcctgagatttgttttagcaaacagatggattctctccaggccatgggatttgggaaccaccatgccaatctacaggcactcattgctactgaaggggacaccaatgctgctatccgcaagctcaagagatcccagagattctaaccaccatgcctacttgtttgcttgctacctgcctgctgacccacctgaccatctcatttgccttttgcacctttcctgatgcttccagccaggagaagtcctggaataagagttatcaaccaatgtgtcttgtactgaataatagatcattggtcgtggctgaaacatctgtcaataaaatggctacactcacttgctgc

SEQ ID NO: 1376 - DNA, 1904 bp, Homo sapiens
aggctgcgaaaggggcgtaacgatgagcggttcctgccagaggtctggggaggataaaaagcaggaggaagaggcgacggcggcctgtggacgtcttgcaggggtccccgaagccaagcagggtcccaaggccgattcagactccgacctagagacggaaggtgctcggggcaggggccaggcccgtctcctccccttgggggcttctcccgcaggggttgtgggaggtgggctggcgccgccgaggaggcaggagacctctgtccagcagggcacgtagccctctgcggggcgtctccagccccctgccctctcctcggcgctcctggcggcatcaggaactttaccatgagaaggcgcttctagaaggaggttaaaatggaaaatcccgccagacagtgcaccaaaggctgtcccgccctgaaatgcaatcagagctgggttttcccaatccacagatgtggacctgttggagaaccagctgggagtggcaggagcccaggccctctgtgccgtcctcacagtgaaccaggccatgcggaagatgcagctgtcagggaatggcctggaggagcaggcggcccagcaccttgccgaactcctgctggcccacacagacctgaagtccctggacctgagctacaaccagctgaatgaccaagcaggcagatctgtgcatgggactgcagggcttcctcatcttccacagctttgggggcggcactggctctgggttcgtgtctctgctcatgaagcggctctcggtggactacgggaagaagtccaagctggagtttgccatttgcccagccccccaggtctccatggccatgacggagccctacaactccatcctgaccacctacacgaccctggaacattctgactgtgccttcatagtcgacagcaaagccacctatgacatgtcagcacaacctggacatcgagtgtcccatgtacaccaacctcagtcgtctgggcagatcgtgtcctccatcacggcctccctgtgattcgatggggccctgaatgtgtacttgacagaattccaaaccaacttggtgccatacccccacatccacctccccctggccacctacgccctggtcatctcagccaagaaggcctaccatgagcagctgtccgtggccaagatcgccagtgcccgcttcgagccagccaatcagatggtcaagtgtgaccctcaccatggcaagtacatggcctgctgcatgttgtacagaggggatgtggtcctgaaagatgtcagtgcggctgtcgccaccatcaagagcaagcacaccaaccagtttgtggactggtgtccgattggatttaaggtaggactgggtgatgtggagtccttgtgccaccaggaagcaggagacctgcagaataatgctgcccctgaaggcccgcatcctttatggagacaaccccttttcacgtcagctaggttgcaaggataataattttagtaatttatttcctaccgccttatactttaccaaatactttatgttccctcataccttaaccactaccctttaaagttcatggggcaatattaccagtatcttacactttagaaaacagaggctgaggctgggcacggtggctcatgcctgtaatcccagcactttgggaggccaaggcaggcagatcacgaggtcaggagattgagaccatcctggctaacacggtgaaaccccggctctactaaaaaatacaaaaaattagccgggtgtggtggcagacacctgtggtcccagctattcgggaggctgaggcaggaggatggcgtgaacccgggaggcagagcttgcagtgagtcgagattgcaccactgcactccagcctgggcaacagagcgagactacatctcaaaaaaaaaaaaaagaaag

SEQ ID NO: 1377 - DNA, 1952 bp, Homo sapiens
agatcaagtgggcagggcttcaccctaaaaggagggggcggggatccaccctagaacaagggggcggggctccaccccagaagaagggggcaaggttcagccctagaacgaaggggcggggccccaccctagaatgagtgggcggggtctatcccagaaccaggggattggactcaaccccatcaaggaggcggggctacactttagggcgacggagcagagctccagggcagggctccactgtagggcaacggggatgggcttggagcgggactctggggacgaggctccactgtagggcctgggggcagagccggggcggcgcgtgaggctaggcttcatcctagaatgagtgggcggggctcgactgatgctgatggtgagcggggccttaccgacacgcgggaccgctcgtctctagaacgcactggccctggtgacagtcgatggcgttgtccacgcccgacgtgcatttggtgacacagcggagccgggtggcctccaccagagggaagtagaactcttcatagcccgtgggagcggcgcggcggcagatggctgggggttggggaggggtatgcacagagacaaggacctcatccattctattcaggggcctgataatggtgcctctgaatatgcgcgaggaggattccatttccgaggtgggatgctgtggggtagaccctgggattcgatgaggggaggccaccgccagcaccctcaccctctcctcgtggcccctgctgtcctcaggtggaagccactaaccaacgccaggaagagcctccctaggccacatgacttgcctcccccaaaggtctctccctgcccacaggcttcaatgggcaaatgtccctggtggcaggggtcatggccatgggagaccactcagccctttaccccaccctcaccttccggggtcagctctgtcttgctgttgttgttcaccttgatggagtcaggcttaaaacacagggctgcggaaacacaggcacagatggaatgggcggggcaggtcaaggggttagggccaggaagcaggataggcacagggagggcagtgagggctctctccgtctgggggagtgtggaggggccacaggggaagactcctgttctctcccttatctcccctgaataatccgaggtcttcagccatcgggaaatgctgagcctgacgatcagggggtctcttccccagtacccaggtcctggggagaccctccctagccccactcttgatggcattgtgtgtagacttattcccgttctcccaacctgccagaggtaccacagggctggcacctgagtccagtggccccctggctgagctggagtgggctggggtgacacctcaggccctggcccctccctccagcccgggctcactctgggagtcctggcagctgttcgcatcctggctggcgttctggagcccctccttcagcgtggtcttcacctgctcatactcgctctccagctgggggctgaagggcatctccagcaggaccagggatgggttctcactatgttgcccaggctggtcttgaactggtttcaggtgatccacccacctaaccttgccaaagtgctaggattgcaagtgtgagccaccacatctggcctgacgttctcgttgcatcaagccatcatccaccgggcgcccctggacgcgcgttctctccctctctctctttctctctctctctctctaatgctgacccactcagtagagcaggggccagccagagggggacgaagtcaccaatccaggcaccaccttcccacatgtccctgcaacttctctctttccagtgtgctgaagaagggaggtgccacccctcctccagataaatggccccagaaaacgatccaaaaaaatacccagggagcgattccttatgtaccccctccacccctctctttataaaatctgatgattacaaaag

SEQ ID NO: 1378 - DNA, 2225 bp, Homo sapiens
ctgtcgcagtgccaggaggccgaacaggcccgtgctgagcttacggcccagcaccagcggcgcttggtggccatagcgcaggagaaggaccaggaaatggagcggctccgggagctgcagcgggcgtccatcctagacatgcgcagagaccacgaggagcagctgcagcggctaaagctgctgaaggaccgagaggtcgatgcggccaccagtgccacctcccacacgcggtccctgaatagcatcatccaccagatggagaagttctccagcagcctgcacgagttgtcctcccgcgtggaggcctcgcacctcaccacctcccaggagcgggagctggggatccggcagcgtgacgagcagctgcgggcactgcaggagcggctgggccagcagcagcgggacatggaggaggagcggagccggcgacaggaggtcatcgggaagatggaggcacggctgaatgagcagagccggctgctggagcaggaacgctggcgggtgactgccgagcagtccaaggcggagtccatgcagcgcgccctagaggagcaaaggaaggtcacggcccagcagatggccatggaaagggcggagctggaacgggccaagagcgccttgctggaggagcagaagtctgtcatgctcaagtgcggggaggagcggcggcgcctggctgccgagtgggcggagttctccgcgcagcaaaagctgagagcaggctgagctgaagatcagggccagcgagctccgggccgaggagaagcagctggcagcggagagagcagccctggagcaggagcggcaggagctgcggctggagaaggagaggatcaacgccaccgccctgcgtgtcaagctccgcgccgaggaggtggagagcatgagcaaggtggcctccgagaagtacgaggagggggagcgggcattgcgcgaggcccagcaggtgcaggcagagcagcaggcccggttgcaggcggtgcagcaacagcaggagcggctgcggaagcaggagcagcacatgcaccaggagcatctgagtctggcccagcagaggctgcaactggaccgcgcacgacaggacctgccctctagcctcgtgggtctgttccccagggcccagggccctgcagcctccagccagagtgccctcatgcctcctgctcccaccacccgttggtgcagccagccgccaactggcctggaccccagccccttgcacctccatgccaggctggcactgctgaggcacatggcagagcaggaccgtgacttcttggagaatgaacagttcttcctggagaccctgaagaaagggtcctacaatttgacatctcattcagcctgagtgggaccccagccgattccccaacagagggttcggaccccagaactgtcctgttcctccggctgcctccatggaggcagtgcctggggaggattctgagatgcttgaggcctgatgacagctcttccgtggacagggtgcaagtgcatcctttccaaatgtgccagcccggggcagcccctgcctctggggctctgtggtgtaggctatcttaccatggctttggctgccctgccccaaagccattggcttggatctgagggtctgagttggcagcaaggacccccagctctcactgggctctgtgggctccccctgggctctgtgggctccccctgctccacaggtagactgttgtgggctctttttgcctgggcctcttctgaggcaggagctttcttgagggatgccacaaacagccttccctactccctgccagagcagttccctccctgatgagctggagaagggccctctggcctcctgacagtacagggagggcaccagctagatcctcccttgtggtgtgagatgttcctggaactcagccaggccctcctcctcctgggcttgcccagagcccccaccctattcccagcattgcccgaaggaccaaccagtttgggtgaacagtggcctcctcagcttcctccccatctgggtgccccaccggcggcggagggagctgtggcgatggtggggtgtggggagggacgaggagggaagcctctgtgctgctcacctgcccaaagcccagctcagcgggtacgcagtggaggcgacaaggaaccaatcacaactacagaggtttctctgatcctcctccactcccgctgcttcaacttgactaagcttaaaaaaactgcttttgccatgg

SEQ ID NO: 1379 - DNA, 1999 bp, Homo sapiens
aaaaaaggcagcgctgggggtgaggagctctggtgagccccttcgaaccagggctgatgggggacctccaccaggaccccggccctgcacggaccctcacagtcaggacaaggggggccagatggggggcacaaggccccacacctcgatggcattgggcgcactcactacctgctaaaccttcctgcttcactgcgtcatcattttagggtctcaaaaggccccaaagagggcaggaggaagccaggcatgtcttttatgaggaaatgggagggagtcaactcggcgaccaccaatgcctacctgggccggtcagtcaatacacaaaacacactaggggccgggcacagtgctcccgcctggaatcccagcactttgggaggccaaggcgggtggatcacctgaggccaggaagaccagcctggccaacatggcgaaaccccatctctactaaaaatagagaaaaaaattagccgtgcatgacagcatgtgcctgtaattccagctactcgggaggctgaggcaggagaatcgtttgaacccaggaggcggaggttgcagtgacccgagatagtaccactgcactccagcctgggcgacagagcaagactccacctcaaaaaaacaacaaaaacaaacaaacaaacaaacaccagaacaaagcgctccaaggacaggccgctctcccgattactaaacagtcacatttagcaacccaaggactaggcaacgctagcatctgtttctgggagaggaaacctgaagcccagagaagtaaaggcacttgcccatgagcacacagccaggcctggcagagctaagattcagacccagggctcaggctctgagagcttcttgctgtatgcaccacctgggccgactcctccagagcagaccctttgtgtcccctatcttatgggaccatgccgtcaggaggcagctggccaggcctccttgtgcctctccgagaggccacctggagagaagaggccaggctgggctcaggcaacagcgggagcccactggactccttcagtgtccaatcacccttccccagtccccaaggccacctctctgccttggtttcctcctcgctcctgcaccctgccctgccaatctccatctgcctctgctcacagctccctccgcctggagaactcttctacagatggctccaggtctcggttccactgctgcctcctccagaagccctccctgaccacctgcccctctgctgttttctccctccctgtaactgtctggagattctgctggctgactcgtctgcctcgtcacccatgggggcccccagagggagctgcgcctcatcctccccgacttaccacgagctgggcgctcctctgcagttccaaggcctgggccgcctgctgctgcaggtacaggaactcctgctgccgcaggaagtgctgctgtgagaagagctgcagctgctgggcgtggtgcagggggctgcggcccggcgggtacagggcgggccagaggggcggtacggtggcccgctccatcagctccgctgcagggacagagacagtgcgctgcacctgcggcctgatgctccaccaccatgcccattacgaggggaagctgaagccagagaggggccacacccacacagtggggagctgggctctctgcgggcccccggctgctccccaggggccaggaagtttgtcctgtcctccatgggccacgtgtgcaccccaggcccggggaacacagccctgtccacacccggggtgggatgttcccacagcctcgcaaccagagcaggtcagcacgcagacacgtacgaggaccactgtgaggacctagggaacgccttctcccacccctcccagtggtctacaaggtggattcctggggaggcggtggcgccaggtaaggggaatcccagcccccacccagggctgcctgtctcgcttctctttatggagtttttgggcaggagctcattgcaacaaggaccccaaggctttac

SEQ ID NO: 1380 - DNA, 1552 bp, Homo sapiens
agtagctcttgccagtaggccgggactagctgtctcggggccttccatccgcttggccccacaggaaaagaccccaatattctcttttagtagcggagcgtgttgatcctgcctgaagtacaccagtgttccgaaggtgcatctggtgatctgcaagaagatgttaaaaactttaagcaagcatcacagtaatggatctctgtcagaaaaatgagactgacttagaaaatgctgaaaataatgaaattcagttcacagaagaaacagaaccaacctatacttgtccagatggaaaaagtgaaaaaaatcatgtttattgtcttctcgatgtcagtgacattacgcttgaacaagatgaaaaagccaaagagtttattattggaactggatgggaagaggcagtccaagggtggggaaggacttctccagctgcctgcatctggccgaggaagataccaaaaaaggcgagggtaggggaaggtgcctgcagcgactgcttggtgtgtgttaacctctcccactggagcctccagaccaagcctcctactgaggggggcccagagaaggatcagagcagcccctcccagactcaggcagccccccagggccccagcactgcttccagggcaattagcgacatctgctttcccacctactttcgagcagagaaaaaaagtctgcaaatcaaggagtttatttggtgcaacaaagactgggccatccccggcactaataggggcaaggcctctgggaatcccagtggaggggcccacagagggctatccatcccaggccccctgacttccagggccctcctagttctgcctcccctgaaggctttactttcaaatgctttggatgttctgggtaagaagagtaagaactctttcttgcagtcagaagagaaggtgctggatgtggaaaaggatgggtgtgtggcttatgcatatggcttgaaaacagcagatgggaaaggtgaaaaaagagccagtgagctggccaaacaccctatggtcaacgacacgccatcctccccttccccagcggcccagatatccctgctgaccgatccggagcagcgctgcctgcattggtccctcctgtctgagaaaaacctggcgtgccctccagaccccagcaacgttcgctaccttgctgccttgcagcttctgcagaaacggggagtgcaaagctacaaatccaaattcaaagccaaggagccaagatctcctgtgatcacccgaaagcatgttctcccaaaggccaagcaggaaaacaggccccaaatgctggagaccaaagttttcccaagacctgtcttgccgtctctcacagtgagcagagttatcattcctgtctctacccacaggatcctctgagcggtcgcggtagaacccctgggaataagcaccgtttgagatgcagccatcctttctctttcttctctctcatttcccacccaccccccactctctctttctctcctccccgtcagtctgtctttactcttcttttcctccatttttttttgtagtacaactgaagaaaactg

SEQ ID NO: 1381 - DNA, 1579 bp, Homo sapiens
actagggagcggcgagccgagacggctacatggacgccactatcgccccgcaccgtatcccccccgagatgccccagtacggggaggagaaccacatcttcgagttgatgcagaacatgctggagcaactcctgatccaccagcccgaagatcccatccccttcatgatccagcacttgcatagagacaacgacaatgtgcccaggattgtaatattaggtccacccgcctcagggaaaacaacaatagcaatgtggctctgcaaacatctgaacagcagtctcctcaccctggagaacctgatcttaaatgagttttcctatacggccaccgaagccagaaggctttatctgcaaaggaagacagttcccagcgcgctgctcgtccagctgattcaggaacgcctggctgaagaggattgcatcaagcagggctggattctggatggcatccctgagacgcgtgagcaggctctgaggatccagaccctggggatcacacccagacacgtcattgtgctgagtgctccagacacggtcctgatcgagagaaacttggggaagagaatcgaccctcaaactggagagatttatcacaccacctttgactggccacccgaatctgaaatccagaaccgtctcatggtgccagaggacatctcagagctggagacggctcagaaactgctggagtatcataggaacatcgtcagggtcattccctcctaccccaaaatcctcaaagtcatcagtgctgaccagccatgtgtggacgtcttctaccaggctctgacctatgtccaaagcaaccatcgtactaatgccccgttcaccccgagggtgctgctgctcgggcctgtgggcagtgggaaaagtctgcaggccgccctcctggcccagaaatacaggcttgtcaatgtctgctgtgggcaactgctgaaagaggctgtggcagataggaccacgtttggcgagctcatccagcccttctttgaaaaggagatggcagttcctgacagcctcctcatgaaggtgctgagccagcgcctggaccagcaggactgcatccagaaaggctgggtgctacacggcgtcccgcgggacctcgaccaggcacacctgctgaaccgcctgggctacaatcccaacagggtgtttttcctgaatgtgccatttgattccatcatggagcggctgactctgagaagaattgatccagtcactggggaaaggtaccacctcatgtacaagccacctcccaccatggagatccaggctcgcctcctgcagaacccaaaggatgctgaagagcaggtcaagctgaaaatggacctgttctacaggaactcagctgacttggagcagttgtatgggtcggccatcaccctcaatggggaccaggacccatacacagtcttcgaatacatcgagagtgggatcattaatcccctgcccaagaaaatcccctgatgggttcagagccaggagcgctgccccagggaaagagttaatcccctgcccccagccccccagcctcggcacagctcccctaaaaagccaataaagcctgctggatacag

SEQ ID NO: 1382 - DNA, 2312 bp, Homo sapiens
aagtaacgctttcttgttaccagatgacagagagtcaggctgtcagagttcacgactttaggtgcacagtttcaccctgtctggtccttgggagacggagaaggggtcaggagaaaacgtgggtgaagaggcagcaaagccgcaggagatatgaactaattgctcaacgtgggtgtagcacggattaggccttttacagcaagcgctgccagcagggaactggtggatgtactcttgaccacgctcggctggactctggggagcccaagacgggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgaggtgatgtggaaacagctgtaaaatttgcaactcagcttattgacctcggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtatctatggctttttcaaccaggctttcttggtgttttttatcttggtttgtttgtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaagtgagtattaagaagatttagaaaaacacctttcaagatgaacatgatgggattctgtgaagaaagaaaagtggagtgctgtatcttttgcattgcttggtagagttttaacacgtaggagaaaaggtgtgataagtgtattgagaagcgttcttcctccctcctttgcaagcgcaattaaaaatgtcaccagtgactaaaactagtgcactgcatatattttatcttcatagaggtcagaactgttaataaaagttaaaggaattt

SEQ ID NO: 1383 - DNA, 2174 bp, Homo sapiens
gaattctgcgtcttcctttaggctgcggcgagacaatccccagagccccgcggcccggcctcggggcagccatggactcgcaggaattgaagactttgattaattactattgtcaagagagatatttccatcatgtattactggttgccagtgaaggaattaagaggtatggaagtgatccagtcttcaggttttatcatgcctatggcacattaatggaaggtaaaactcaagaagctcttcgagaatttgaggctattaaaaataaacaagatgtatcactttgttctctacttgcactgatatatgcccataaaatgagtcctaatccagatagagaagctattctggaatcagatgccagagtgaaggaacaacgtaaaggagctggagagaaagccttataccatgcaggcttatttttatggcacattggtcgccatgataaagcaagggaatatattgacagaatgatcaaaatatcagatggtagtaaacagggacacgttttgaaagcatggcttgatattacaagaggaaaagagccttacactaaaaaagcactgaagtattttgaagagggactccaagatgggaatgatacttttgctctgctgggtaaggcacaatgccttgagatgcgccagaattattcaggtgccctggagactatgaaccagataatcgtgaattttccgagcttccttcctgcttttgttaagaaaatgaaattacaactagccttgcaggattgggaccagacagttgagacagcacaaaggttgctgctccaagatagccaaaatgtggaagcactgagaatgcaggcactctactatgtgtgtagagagggggatatagagaaggcttccaccaagctggaaaacttgggaaatgcattggatgccatggaaccacagaatgctcaacttttctataacattacactcgccttcagcagaacttgtggacgtagtcaacttattcttcaaaaaattcaaacgttacttgagagagcttttagtttaaaccctcagcaatcagaatttgctacagaacttggataccaaatgattttacaaggaagagttaaagaggcactgaagtggtataagaccgccatgacacttgatgagactagtgtgtctgccctagttggatttatccaatgtcagttgatagaagggcaattacaggatgcagatcagcagctagaatttttaaatgaaatccagcaatccattggaaaatctgcggaattaatctatttacatgcagttcttgccatgaagaaaaataaacgacaagaagaagttattaatttgttaaatgatgtcctggacactcacttttcacaattagaaggtttgcctcttggcatacagtattttgaaaagctaaatcctgatttcttgttagaaattgttatggagtatctgagcttctgtccaatgcagcctgcaagtcctgggcaacctctttgtccacttctcaggcgttgcatctcagtcctggagactgtagtaagaactgttccaggtcttctgcaaacagtcttcctaatagcaaaagtgaaatatttgtcaggtgatattgaagcagctttcaataaccttcagcactgcttagaacacaatccctcttatgctgatgctcatctgctgctagctcaggtttacttgtctcaagaaaaagtcaaattgtgttctcagtctcttgaactttgtctgagctatgattttaaggtgagagactatcctttataccatttgataaaagctcagtcacaaaagaaaatgggagaaatagcagacgcaattaaaacactgcatatggcaatgagtttaccaggaatgaaaagaattggagcttccacaaaatcaaaagacagaaaaactgaagttgatacaagccatcgtttatcgatctttcttgaattgatagacgttcaccgcttaaatggagagcagcatgaggcaaccaaagttttacaagatgccatccatgaattttctggaacatctgaagaagtgcgggttaccattgctaatgcagaccttgctctagcccaaggaggtattgaacgggctttaagcatccttcagaatgttacagccgaacagccttattttatagaggccagagaaaaaatggcagatatttatctgaagcac

SEQ ID NO: 1384 - DNA, 2058 bp, Homo sapiens
acccacgccaccgacgccggttgctgccggagccgttagagggaggagacaaacgaaccgaggcgggagcggccacgggtgacagcggcagcggcggggccgggctgcgctcccgaaggcgttcctggagggccctgggatggactcagagatccccagagccccaggggacggaaaatctagccccgggcacttgccttggagtctgagtgatgcgcgtcgttggagcgcgaagccggtctccctagcctccgcccgacacagcgtctccaggggttttcctccttttcgcgcctctccttccctcttccccacaccatttgagagcctcaaatggtagtcctgccgccacctctctcccttcgccagcctgccatcgtccccatgggtgcagatatgcgctcccgaagccgcctgcctgccgcgtctgcctcgggcatcagcccacgagtggggagtcggctcagcttgccacgagggaacctcgggttaggaccaatcgcccgggagagagccctcctcgcccccgcacctcctgctccaagtctcctgtcctggttatcccaagttcagggcccacctggggtcacatggggaactacttgtcttaaggctgtaaacaatagttggaagaggagttgctagcttttgagaacttccatgatcatccaaagtctgaaacaaagtaggcggtcagcctttcaaaatacgtgttggaagaaacagacaccttcccatccccagcgtttgttcagtgccttggttgggctttgattctcactgctttgtgaagtacagcttatttttacccccaagattatgattttcaggctgtagttattattggacaactgagaggtgattttgttgttgttgaaatgagggaaaacgggccattagaaaggaccgtgtctcttaagaggagggaaaaaaaggacagcgagttggtaatggaatgttgctggatggattacatagatgagacatgggagatagaatagagaatccagaaattctcatgtatgtgtgcgtgtttagtataataacagtagctcacatttgctgagcatttgtgtggcaagtactggagtactttttcaggttatcttatttaactctaacatttctgtaaggtaggtgcaattgttatctccatttcacagagttgcccaaaaccattacttttaaacgctggagccagacaactccagaaatctctgtggtagccagtaaactatacatgacaaattattggtcagtaggaaaaagatcattcgggaaatggcggtggctcacgcctgtaatcccagcacgctgggaggccaaggcaggtggatcacctgaggtcaggagttcgagacgaccctggccaacatggtgaaatcccatctattaaaaatacaaaaagccaagaaaaacaaatattcaattaacaaacggaaagttgtcccacttccaaacagttgttttttgtctatcattgttgataggggtgtgggatacaattactgtcaggcatttttggtgtgaaggtgaaattggtacaaccctatttaccaaaatttaacatatgcattagcctttgccccacagctgtctcatttccgaggcatataccctaaggaaaataagggattcataaggatactatttgccaccttttttaaaaataatgcttctagaaacaagtgtccatcactaggacactagttaagaaaattatgattggtacatgcaatggaatactcttgacccattaaaaactgatggaaagttctttatttgcattaaagtatgtccaaaaaatatagtttcccctcaggaaaaaaaaagcagaatgtagtttagcaagtacagtgctgtcctaatgtgaatatatgtgtgtacatatgttaatataagtgtacaaaaatatctggaagaaggtcagtcaaaatacaagtgttttacattttgtcttttggactttttatctggttggtgttttttgtaatttattattttacaaaaacaaagttgtgttttatgttttaattaaagctgtgccagtgaaaaggg

SEQ ID NO: 1385 - DNA, 2012 bp, Homo sapiens
gcggtcgaagctcacgcggtaagccgctgcacgtgtgctacggcgggcggagggccgaaagtccagtatgtgggtccagggtcactcttctagagcttccgcaacggaaagtgtgagtttttcaggaattgttcaaatggatgaagatacacattacgataaagtggaagatgtggttggaagtcacatagaagatgcagtaacattttgggcccagagtatcaatagaaataaggatatcatgaagattggttgctcactgtctgaagtttgcccccacgccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtaagaaaatgactcttgacttgaatgatgaaaatgatgcaggcaatcttataacatttccaaaggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaagaagattcccagtgtggatcacttgctatccattaagaagacattgaaaagcttaaaagctctactcagatggaaattggttg

SEQ ID NO: 1386 - DNA, 2296 bp, Homo sapiens
agcgcgctaggctcacaaaggcaggcacagactgcaaccctgctcagtgctccgggcgcttcaggctggcttgggtcctgctgctccaaccccaagggccctggagcgctccctgatacctccatcactcaccatggccagccagttctgcctccctgaatccccatgtctctcgcccctgaaacccttgaagccacatttcggagacatccaagagggcatctacgtggcgatccagcgcagtgacaagcggatccacctcgctgtggtcacggagaccaacagagaaaactattgggtcacggtagagtgggtggagaaagcagtcaaaaaaggcaagaagattgacctggagaccatactcctgctgaatccagctctggactctgctgaacaccccatgccgcccccgcccttatcccccttggctctggcgccctcttcggccatcagggaccagcgtaccgtcacgaaatgggttgcgatgatcccccagaaaaaccaaacagcctcaggggacagcctggatgtgagggtccccagcaaaccttgtctgatgaagcagaaaaagtctccctgcctctgggaaatccagaaactgcaggagcagcgggaaaagcgcaggcggctgcagcaggagatccgagctagacgcgccctcgatgtcaataccagaaaccccaactacgaaatcatgcacatgatcgaagagtatcgcaggcacctggacagcagcaagatctcagtcctggagcccccgcaagaacatcgcatctgcgtctgcgtgaggaagcggcctctcaaccagcgagagacaaccttgaaggacctggatatcatcaccgtcccctcggacaatgtggttatggtgcatgagtccaagcaaaaggtggacctcactcgctacctgcagaaccagaccttctgcttcgaccatgccttcgatgacaaagcctccaacgagttggtgtaccagttcaccgcccagccactggtggagtccatcttccgcaagggcatggccacctgctttgcctatgggcagacgggaagtgggaagacgtacaccatgggtggagacttttcaggaaaggcccaagattgttctaagggcatttatgctctggtggcacaggatgtctttctcctgctcagaaactccacatatgagaagctggacctcaaagtctatgggacattttttgagatttatgggggcaaggtgtatgatttgttgaactggaagaagaagctgcaagtccttgaggatggcaatcagcaaatccaagtggtcgggctgcaggagaaagaggtgtgttgtgtggaggaagtgctgaacctggtggaaatagggaatagctgtcggacttccaggcaaacatctgtcaacgctcactcatccaggagccatgcagtgttccagatcatcctgaagtcaggagggataatgcatggcaagttttccctcgttgatttagctgggaatgaaagaggagcagatacaaccaaggccagccggaaaaggcagctggaaggggcagagattaacaagagtcttctagccctcaaagaatgtattctggctttgggtcagaacaagcctcacaccccattcagagccagcaaactcacactggtgctccgggactcctttataggccagaactcctccacttgcatgattgctaccatctctccggggatgacctcttgtgaaaacactctcaacactttaagatatgcaaacagagtaaaaaaattaaatgtagatgtaaggccctaccatcgtggccactatccgattggacatgaggcaccaaggatgttaaaaagtcacatcggaaattcagaaatgtcccttcagagggatgaatttattaaaataccttatgtacagagtgaggagcagaaagagattgaagaggttgaaacattacccactctgttagggaaggataccacaatttcagggaagggatctagccaatggttggaaaacatccaggagagagctggtggagtacaccatgatattgatttttgcattgcccggtctttgtccattttggagcagaaaattgatgctctgaccgagatccaaaagaaactgaaattattactagctgacctccacgtgaagagcaaggtagagtgaagccaatggcgagagatcaggtccgaaatgctgcattgctgcagtttccaccactcttatacaggaaaactgtccaaataattatctaaagatcctcctgagaagcttaaaacatcttaaaatacactgatgggaaacatg

SEQ ID NO: 1387 - DNA, 1907 bp, Homo sapiens
acttgctctgcagctcccagaggtggtggttgtgttacgaaggctgaccctgccaatggccgacaaaatggtgcgcacccccaagtgctcgagatgcaggaaccatggcttcctggtgcccgtcaagggacacgcgggcaaatgccgctggaagcagtgcctctgcgagaagtgctacctgatctccgagcgccagaagatcatggccgcgcagaaggtgctcaagacgcaggccgccgaggaggagcaggaggcggccctgtgtgcgcaggggcccaagcaggcctccggggctgcggccgccgcccccgcccccgtccccgtcccggccgcgagcctccgcccgctgtccccggggactccctccggagacgccgacccgggacccgagggccgcgcggccgcttgcttcttcgagcagcccccgcggggccggaaccccggcccgagagccctccagccggttctgggcggccgcagccacgtggagccgagcgagcgagccgccgtggcgatgcccagccttgcgggacccccttttggggcggaggccgcaggcagtggctaccctggccccctagacctgcgcaggccgatgcggaccgtgcccggcccactgttcaccgactttgtgcgccctctgaacatcaacccggaccgtgcactgggccctgagtaccctggtggctccagcatgcacccctactgcccgttcccgctgggctacctggacgcccctcctggcgtccccctgcagcagggcttccggcatgtgtcccgcagccagtaccaaggcggaggcttggtgtcagaaccaggaggagacttccagccaagctactacctgccgccgccgccgccgccactgccgccccttccaccgcttccaccgcagccccagttcctcccgccaggctacctctctgcgctccacttcctccccccgccaccgccaccaccacctccatcatctttctcactgaccgtcctgtttgatactgacaaggagaacactgatgaccaggatgcagaggtactgtcgggtgagcccagccagccatcgtctcaggagcagtccgactaggccccaggcccgccctcctggccagcagagtggggcactggggggcaacagcaacagttttcctgtcttcattcagtgatatgtagggaggaaggaggttgatagcatagatggcaactgattcccagtttaagataggaggaaggagagcaatttctaagtttcaatcctgcgctgtacagttgaagaagagtgtggaggaagctattaccaggggagggccagggctctgaggagtgggcgctgggagaagctcccatttaggaatgaatttaactgtccttgggttacactaccatttattggaacaagccccagaggcagtatttgatttcctcaggccccactctaggacaggaggcaccatctatttcagccttctgctgcctttgcctggtcctccaggttgctgggggcaccacagacatcaagattccagttcatccaggtggctggagccagcagccaggaccagggtcgttgacagcaggttctgcagcatcctgccttgctgctctgtcccccacatcttcctggccacagccccttgcccctcctctaaggggttttactagcaagcatcctggctgctggggctacttcattccccctccataaagtttcagccattatgggcactggttttaaaaaatttattagtttgactatttgatggttttatagtgattgccaactttaaaaagtaggctgttcataagcactgatgcagtccctagggaatagaatggtgcttctgatcacctgtgacatgaacagtttcttctgtgaggacagttggctattgaaataaaatgagcaatgg

SEQ ID NO: 1388 - DNA, 2104 bp, Homo sapiens
tttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacaggtaagtactgaggaggccttggcaggagctctgatccccctcctaccatcccaaccccaccctgatcctgattgaattctgttagtcactgatcagctgctatgagactgctaggccaccagagccttggacaccaaaggcagtacaatataaggtcaatcaaaataaaaagagaatgaaccaattcttttttcttttttcttttttgagatggagcctcactctgttgcccaggctggagtgcagtggcacaatcttggctcactgcaacctccacctcccaggttcaagagattctcctgcctcagcctcctgaatagctggaactacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctg

SEQ ID NO: 1389 - DNA, 3497 bp, Homo sapiens
cttttcggcccagtagcggcggctcagttgctgccatggagtcagccgggctagagcagctcctacgggagctgctgctaccggacaccgagcgcatccgtcgggccacggaacagctccagatcgttcttcgggcccccgccgctttgccggctctctgcgacctgctagcctcggcggccgacccccagatccgccagtttgcggccgtgctgacccgcagacgactgaacacccgctggcgacggctggcggcggagcaacgggagagcctcaagtccctgatcctgacggccctgcagagagaaacagagcactgtgtgagcctcagcctggcccagctctcagccaccatttttcgaaaggaaggcttggaggcctggccacagcttttgcagctgcttcagcacagtacccacagcccccacagcccagagagagagatggggcttttgctgctaagtgtggtggtgacctcccggcccgaggccttccaaccccaccaccgggagcttcttcggcttctgaatgagactcttggtgaggtgggctctcctgggctgcccttctactccctgcgcactctgaccaccatggctccctacctcagcactgaagatgtgcctctcgctcggatgttggtgcccaagctgatcatggccatgcagactctgatccccatagatgaggcaaaggcctgtgaggcccttgaggctttggatgaactgttggagtcagaggtgccggtcatcaccccctacctctctgaagtcctcacattctgcctggaggtagctagaaatgtggccctgggcaatgcgatacgcatacgtattctctgctgcctcactttcttggtcaaagtcaagaacaaggccttactgaagaatcgtctcctgccacccttgctgcacacccttttccccattgtggctgctgagcccccaccaggccagttggatcccgaggaccaggattcagaagaggaagagttggagattgagctgatgggggagactcccaagcatttcgctgtacaagttgtggacatgctggcactacacctgccccccgagaagctctgtccccagctgatgcccatgttggaagaggctttgcggagcgagagcccataccagcgcaaagctggactcctggtgctggccgtgctgtctgacggagctggcgaccacatcaggcagagactgctgcccccactgctgcagattgtgtgcaagggcctggaggacccctcgcaagttgtacgcaatgctgcgctgtttgccctgggccagttctcagaaaacctacagccccatatcagcagctattcaagggaggtaatgccactgctcctcgcctacttgaagtcggtgcctcttggacacacacaccacctagccaaggcctgctatgccctggagaattttgtggagaacctagggcccaaggtgcagccctaccttccggagcttatggaatgcatgctgcagcttctgaggaaccccagcagtccccgggccaaggagctggctgtgagcgccctgggagccattgctacggctgcccaggcctcgctgctgccctacttccctgccatcatggagcacctgcgggaattcctgttaacaggccgtgaggaccttcagcctgtgcagatccagagcctggagacactgggggtgctggcacgagcagtgggggagcccatgaggccgctggctgaggaatgctgccagctgggtctgggcctctgcgaccaggtagacgaccctgacttgcggcgctgcacgtacagcctatttgcagccttatcgggtctgatgggtgagggcctggcgccccacttggaacagatcaccacgctcatgctgctgtcactgcgttccaccgagggcattgtgcctcagtatgacgggagcagctccttccttctgtttgacgatgagagtgatggggaagaagaggaggagctcatggatgaggatgtggaagaagaggatgactcagagatctcagggtacagcgtggagaatgccttcttcgatgagaaggaagacacctgtgctgccgtgggggagatctctgtgaacaccagtgtggccttccttccatacatggaaagtgtctttgaagaagtatttaaactgctggagtgccctcacctgaatgtgcggaaggcagcccatgaggctctgggtcagttttgctgtgcactgcacaaggcctgtcaaagctgcccctcggaacccaacactgctgctttgcaggctgccctggcccgagtcgtgccatcctacatgcaggcagtgaacagggagcgggaacgccaggtggtgatggccgtgctggaggccctgacaggggtgctccgcagctgtgggaccctcacactgaagccccctgggcgcctcgctgagctctgtggcgtgctcaaggctgtgctgcagaggaagacagcctgtcaggatactgacgaggaggaggaagaggaagatgatgatcaggctgaatacgacgccatgttgctggagcacgctggagaggccatccctgccctggcagccgcggctgggggagactcctttgccccattctttgccggtttcctgccattattggtgtgcaagacaaaacagggctgcacagtggcagagaagtcctttgcagtggggaccttggcagagactattcagggcctgggtgctgcctcagcccagtttgtgtctcggctgctccctgtgctgttgagcaccgcccaagaggcagaccccgaggtgcgaagcaatgccatcttcgggatgggcgtgctggcagagcatgggggccaccctgcccaggaacacttccccaagctgctggggctcctttttcccctcctggcgcgggagcgacatgatcgtgtccgtgacaacatctgtggggcacttgcccgcctgttgatggccagtcccaccaggaaaccagagccccaggtgctggctgccctactgcatgccctgccactgaaggaggacttggaggagtgggtcaccattgggcgcctcttcagcttcctgtaccagagcagccctgaccaggttatagatgtggctcccgagcttctgcgtatctgcagcctcattctggctgacaacaagatcccaccagacaccaaggccgcactgttgctgctcctgacgttcctggccaaacagcacaccgacagctttcaagcagctctgggctcactgcctgttgacaaggctcaggagctccaggctgtactgggcctctcctagactgcaggctgcagccagtccagagagaatagagcctgcccaggccttaagaccacctctcagcccagttcagttctgccttaccaaagattctgagactcatacccatttggagccagccccacttgctgccttacagggctgtccctgaggctggatctgttacaaatgagtcatgacatcatactgtaataaaagcagcttgttttctgcttg

SEQ ID NO: 1390 - DNA, 1779 bp, Homo sapiens
ctccactaaaaatacaaaagttagtcaggcatggtggcacgcacctgcattcccagctacttgggaggctgagggaggagaatcctttgaacatgggaggtgggttccccaggcttagagcaaaacccccatcttgtccgtctccactctcatcccaggcaatcacggtcatttccacagcctcaaccactgtctacctgggatgcctcccaagcccaagtctccagcccaaacctgccttcctagccccagacccatctgtcctggcacacgttgccccctgggtcccaagcaacctcagccaatgagtccaacgtcaacttcctgtccttgcctgacactgtcagccctgagatcagacttgaccattcacctccagtacctgataggtccgtcagtcctttggaacatatcccacgaatattccctaaaccaggcaccggactccacacatcaacaccgtcatgtgagtcaccagcatccctggcagggacccctgtcccagcctccaactcatctccttcctgtcccttgagttctgtgtcacattccagaggccacaagaagaaaaatgacaaccttaatgaaattaaaagaattgagaagacatttccctatggtccaaagtctttccaactgagaaacacatatcaagatccggcctgccaaccctgcggttaaatgttcctgaaataattaaagcccagggcaacacagcccgcactccacaagtactcccagcacagtaagacttgcttctctggaggggcttgaaatgtccagtgtgtaccctgcccctctctgtcgtagctaacaggaatgtgcttcatgtcttcttcctgctcaaaggactgtccaccaacatgcgcaggtagcactttcggccagggggggatgcgagaacttcccaccatttcccacttacgcactgcattcctcaggagcctgcctcacaaattacaagagcgccacggcagacacaccacgttccagtgggtggccatgtcttcatgtcagcttgaaagatcgtcaccagggaaatatctatatctcggcagagaaagcttcagcctgtgtagtccagctgtgctcaaatggaaatccagaaacccagatgttggtccaaacaccctgtctcggacagccagctctgcaggtccccagcgtgggagtgaactgggtgggccacctaccctgcctgcccacatccctgcttcctggaatcctggaccctgagaaccagggggatgtggtggggaacaggcaagtcttgtgcagaaagccaagatgccacccaaatccactctgcagtctaggtgggtgatattctggtctgcaccacaccagtgcatgaggggatggaggatggagtctagacaagccaaatgtaaaaaggtattgcccaagtattttgtgctttgtctgtgttacaatgctatgcccagcccagcgtggtggctcacacctgtgatctcagcaccttgggaggccgaggcaggcggatcaccttaggtcaggagtttgagaccagcctggacaacatggtgaaaccccatctctactaaaaatacaaaaattagccaggtgtggtggtgggcacctgtaatcccagctactcgggaggctgaggcaggagaatcacttgagcccaggaggtggaggttgcagtgagcagagatcatgccactgcactccagcctgggcaacagagtaagactccatctttaaaaaacataaaaataaataaatgctatgcccagcaaaaaaaaaaaaaaaaag

SEQ ID NO: 1391 - DNA, 1754 bp, Homo sapiens
aggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagagatttgaacatggaattcaatccttcagatcatcctcgggccagcacaatattcctcagtaaatctcagacggacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccgtcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgagcgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctg

SEQ ID NO: 1392 - DNA, 1537 bp, Homo sapiens
attccaagaacctggacaacttgccgtcaagactttccatcaggtcttaaaaataaatatgaatttagattccatacatcgattaattgaggaaacacagatcttccagatgcaacaatcatcaattaagtcacgcggcgacatggtggcccctgcctcaccccccagggatacctgtaatacctgcttcccacttcatgggctacaatctcatgctgctcacaatttctgtgctcactcatataacaccaacaaatgggatatttgtgaagaacttcgcctgcgggagcttgaagaagtcaaggccagagctgctcagatggaaaagaccatgcggtggtggtcggactgcactgccaactggagagaaaaatggagtaaagttcgagctgaaaggaacagtgccagggaggaaggaagacaactcagaataaaactagagatggcgatgaaagaattgagtacactgaaaaagaaacagagtttgccacctcagaaggaggcattagaagctaatgttacccaggatctgaagcttcctggcttcgtagaagaatcctgtgaacatacagaccaatttcaattgagttcacaaatgcatgagtctatcagagagtatttggtaaaaagacaattttctacaaaggaggacacaaataataaggaacaaggtgtggttattgattctctaaaattaagtgaggagatgaagcccaatctagatggtgttgatttattcaacaatggtggttctggaaacggtgaaacgaaaactgggctgagactgaaagcaataaatctgcctttggaaaatgaagtaactgaaatttcagctttgcaggtgcatttggatgaattccaaaaaatcttatggaaggaaagagaaatgcgcacagctttggaaaaagaaatagagagactggagtcggctttgtctctgtggaagtggaagtatgaagagctgaaagaatcaaagccaaaaaatgtgaaagagtttgacattcttcttggtcaacataatgatgaaatgcaagaactgtcaggcaatataaaggaagaatccaaatctcaaaacagcaaagacagagtgatttgtgagttaagagcagagctagagagattgcaagctgaaaatacctcggagtgggacaagagggaaatacttgaaagagaaaagcagggactggagagagaaaatagaaggctgaagatccaggtgaaagaaatggaagagcttttggataagaaaaatagattaagtgcaaactctcaaagtcctgatttcaagatgtcacaaattgatctgcaagaaaaaaaccaggatgtaaaataacgttcatgcatctgaaacaaagtgtgtcaaatgttaaaatatgacaaatcttcagacagtttcaagatttccaaaaggaagaagaaaaatgaagtaagaaatagaactttctggttttttgtttcttattaaagctttgtctcagtattttctaagctaatgatcttatttccaataaagattttttcattaattcaagcgact

SEQ ID NO: 1393 - DNA, 1847 bp, Homo sapiens
atttcagaacttggaccctggtaaaacagggctggccttatcccaagggcctgcactcccagtcttgaatgagggagccccactgtgggagcaccgtgttccctggggacccaagagaatcctcccctgctggggtggcagagacaggcacaaggatagactgtctcactgtgcgctgctcccccgcagattccaggacctgctcctctgttttcttcagggtcttgctttgttcttctctatctcttcttcccaccactggaggtgtcccagcctcctttctcctcttctctattcttttcttttttctcctcttctctgtggcaggtgcctcaggtcagaagccacagtctgcacagagcaggctgtgctctcctgaggaacccccctaacaccgtttggtctcttccgtcactgctctgaggacaaatctctttgcacactttgcatactttactaacagagaatgctgactgctgatacgatattattctggtgtgaaagtgggtgtctttaattaattttaatgacggattctcaaaggtacatcagcaaaacagtctgatgaaaatggggaggctgcctatgatctgccagctgaggactggatagatgcaaagatctttgtgcgtgtgaaggctgttaatgcagctggtgccagcgagcccaagtactattctcagcccattctcgtgaaggaaatcatagaacctccaaagattcgcatcccaagacacctgaagcaaacctatatccgcagagttggagaagctgtcaatctggttatacctttccagggaaaaccaagaccagaattaacttggaagaaggatggtgcagaaattgataagaatcaaataaacattcgcaactctgagactgatacaatcatatttattagaaaagcagagaggagccactctgggaaatatgatctgcaagtcaaagtggacaaattcgtggagaccgcatcaattgacatccagatcattgaccgtccgggtccaccccaaattgtgaagattgaggatgtctggggagaaaatgtcgctctcacatggactccaccaaaggatgatggaaatgctgctatcacaggctataccattcagaaggctgacaagaagagcatggaatggtttactgtcattgagcattatcatcgaaccagtgccaccattactgaattggtcatagggaatgaatattacttccgggtcttttctgaaaacatgtgtggcctcagtgaggatgccaccatgactaaagagagtgcagtgatcgccagggatggtaaaatctacaaaaatccagtgtatgaagactttgatttctcagaggcacccatgtttactcagcctttggttaacacctatgccatagctggttacaatgccaccctaaactgcagtgtgagaggaaatcctaagcctaaaataacctggatgaaaaacaaagttgctattgtggatgatccaagatacaggatgttcagcaaccagggagtctgtaccctggaaattcgcaagcccagcccctatgatggaggcacttactgctgcaaagcagtcaatgaccttgggacagtggagattgaatgcaaactggaggtgaaaggtgggctctccttctgcagactcctcttgcaaggcgtacctccaaacataattgattcatatctgcgagacttacactcaagcaatcctgaggaatactgagggagggcctggctactgtctctctgcactctgctgctttgaaatctggttgaaatgagaaaaagcattttctgttttcccaccaggcccccaagtgtggtctttttctttcctcctaatgttgaagag

SEQ ID NO: 1394 - DNA, 2160 bp, Homo sapiens
ctttttgttaacttgccgtcagccttttctttgacctcttctttctgttcatgtgtatttgctgtctcttagcccagacttcctgtgtcctttccaccggtcctttgagaggtcacagggtcttgatgctgtggtcttgatctgcaggtgtctgacttccagcaactgctggcctgtgccagggtgcaagctgagcactggagtggagttttcctgtggagaggagccatgcctagagtgggatgggccattgttcatcttctggcccctgttgtctgcatgtaacttaataccacaaccaggcataggggaaagattggaggaaagatgagtgagagcatcaacttctctgacaacctaggccagtgtgtggtgatgccaggcatgcccttccctagcatcaggtctccagagctgcagaagacgacggccgacttggatcacactcttgtgagtgtccccagtgttgcagaggtgagaggagagtagacagtgagtgggagtggcgtcgcccctagggctctactggaccagcgtctcctgtctcctggagaggcttcgatgcccctccacaccctcttgatcttccctgtgatgtcatctggagccctgctgcttgcggtggcctataaagcctcctggtctggctccaaggcctggcagagtctttcccagggaaagctacaagcagcaaacagtccgcatgggtcatccccttcactcccagctcagagcccaggccaggggcccccaagaaaggctctggtggagaacctctgcatgaaggctgtcaaccagtccataggcaagcctggctgcctccagctgggtggacagacgggctggagaaggggagaagaggaaagggggttgcctgccctgtctcctacctgaggctgaggaaggagaaggggatgcactgttggggaggcagctgtaactcaaagccttagcctctgttcccacgaaggcagggccatcaggcaccaaagggattctgccagcatagtgctcctggaccagtgatacacccggcaccctgtcctggacaagctgttggcctggatctgagccctcgtggaggtcaaagccacctttggttctgccattgctgctgtgtggaagttcactcctgccttttcctttccctagagcctccaccaccccgaaatcacatttctcactgccttttgtctgcccagtttcactagaagtaggcctcatcctgacaggcagctgcaccactgcctggcgctgtgcccttcctttgctctgcccgctggagacggtgtttgtcatgggcctggtctgcagggatcctgctacaaaggtgaaacccaggagagtgtggagtccagagtgttgccaggacccaggcacaggcattagtgcccgttggagaaaacgggaatcccgaagaaatggtgggtcctgaccatccgtgagatcttcccagggcagctcccctctgtggaacccaatctgtcttccatcctgtgtggccgagggccaggcttctcactaggcctctgcaggaggctgccatttgtcctgcccaccttcttagaagcgagacggagcagacccatctgctactgccctttctataataactaaagttagctgccctggactattcaccccctagtctcaatttaaaaagatccccatggccacagggcccctgcctgggggcttgtcacctcccccaccttcttcctgagtcactcctgcagccttgctccctaacctgccccacagccttgcctggatgtctatctccctggcttggtgccagttcctccaagtcgatggcacctccctccctctcaaccacttgagcaaactccaagacatcttctaccccaacaccagcaattgtgccaagggccattaggctctcagcatgactatttttagagaccccgtgtctgtcactgaaaccttttttgtgggagactattcctcccatctgcaacagctgcccctgctaactgcccttctctcctccctctcatcccagagaaacaggtcagctgggagcttctgcccccactgcctagggaccaacaggggcaggaggcagtcactgaccccgagacgtttgcatcctgcacagctagaggtcctttattaaaagcacactgttggtttctgctc

SEQ ID NO: 1395 - DNA, 1619 bp, Homo sapiens
agatctatctggaggagtttctgtggagccagccaccctcaccaggtgccttccattagagtttaatgctttgctgcggtttcctgaaagagccccacagagagtgggtctcgatgggtcctgaaccgcaccacaaccggccagtgagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtgagaggccctccagctgcaggggcatttaaagaaagaccaaccaagcccacagcatttcgaaaattctatgagcgaggtgacttcccaattgcccttgagcatgattcgaaaggaaacagaatcgcctggaaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaaatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatgggtcttactctttgcccaggctggagtgcagtggcgcgatcatggctcgttgcaacctcgaccacctgggctcaagtgatcctcccacctcagcctctcaagtagctgagattatagtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgcctgtttcttagattacaatagtgtactgtgcttatttgttctaagagaagaattgcttctttatacagctccgacagaagcaggagtccgagttaaaccttcagttgtatagacaataaactataattttcatatgcaattcagcaattgctgttctgtgtgtgcctgccctgggggtgatgtcagaggttgtaagggaagagtttatgctgactgcttactaggtgtttgtcatggaagagaagcatgggttcagcagtgcctctctagcagctgtgcggaataatgtgctttgacgttcaataaaactgttgaatct

SEQ ID NO: 1396 - DNA, 2713 bp, Homo sapiens
gtgctcgaccgcgaatcccgtgtgcagtcgccccgcgccccgcgcgacccttcgggtaaactacgaactgggagttctgaagaatgggtaaagactttcgttactatttccagcatccctggtctcgcatgattgtggcttacttggtgatcttctttaacttcttaatatttgcggaggacccagtttctcatagccaaacagaagccaatgttattgttgttggaaactgtttttcatttgttacaaataaataccctagaggagttggctggaggattttgaaggtgcttctatggctacttgccattctcacaggactaatagctggcaaatttctgttccatcagcgtttgtttggtcagttgctccgattaaaaatgtttcgagaagatcatgggtcgtggatgacaatgttcttcagcacaattctctttctcttcatattttctcacatatacaacacgattcttctaatggatgggaacatgggagcatatatcattacagactatatgggcatccgaaatgaaagtttcatgaaattagctgcagtagggacctggatgggggactttgtcacagcttggatggtcactgatatgatgcttcaggacaaaccctatcctgactggggaaaatcagcaagagctttctggaagaaaggaaatgttaggatcactttattctggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggactgggaattcccacatttcatgggagatgttgatgtaaatctccctggtttgcacacccctcacatgcagttcaagattcctttcttccagaaaatcttcaaggaggaatatcgtattcacataacaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactagactcggagatagacttggagataacacaaaaagcaaccttgagtgtaactttaaaaatttagtctttccttttgtatatgtaaggtttacgtagtgttaggtaaaaatatgaacaatgccacaacggtgctcaacatgctttttctaggattcattgttttctatttgtattataatacacgtgcctactgtatactcaacagtcctctagagattgcttttcacaattgcacaagctattactgactttacagcatagtggaagattagctgatgacccatgtatctgatgttcaaccatagtggtgccttgagacattaaactgtttttaactgtaccagaaatgaagtgtggaacagttacctaacctatttcacatgggcgttttgtatacaactattttgatctacacttgatgtctgagcagaaaacagaaatagctaaatgtgactcaggaagtatctcttggtttcttattcagcagcagagttggtgactttgacaactggactgcagagaaacatggtgatcaccttttaatttttattggctgtctgccaaatataaatacagatgcaaaattcagtaataggagatccataacccaacatgggtcactactcgtgaaatgtgactttctcccaccagtaattgaaatgaggtgatgatacctaattatgttttcctaattaaagataaattgctacttgattaaaaatcctgcccttcacctttgggaacaaaggttaagagacacagttgggcgaactctcaaatttattggcatttacacaaagtcccagacaaccaaggaactgaagttttcatcatatgagagcagcacatcccaccatttacaatattcgtatatctttctgcaaatatggctctggatagtgaaaattgaaaaacatatgccaaccctgagcaagggaactcctcaaaaaatcatgcagcggaaccttgtcaggtagagaagccgtgcatgaaagaatttgtttaatgtcttgttttgcgtatgtgttttttgtttttgttttttaagaactaaatattgcacattaataaataagaattatacagc

SEQ ID NO: 1397 - DNA, 2060 bp, Homo sapiens
aagaaaaggagagggaagaacagaatgagaagactttgggacatttcatgagtcattcaagcaacatttctaaggctgggagtcctccgtcagcatcagctccggctccggtgtcctccttctctcgcacttctatcacgccatccagccaggacatctgccagagttctctgacacaagggctcactgtgacagttatctgtaaggacacattacaggcgtcaaagagaaattcctttggttcagaatgggcccaggccttgaagcctgctaagaataccaaagccagaagaacactaaagttctcaaggtccctcaatgatgtgggtgagaagggaaattaatactccctcaagatacgtgtctcagaactaacaggtttcatcataaagaaaaaagaaccctgaaccacaaacctcttggcaattccaaacattcttgtgtttcatgcctttctgccggtcgctcaactgcctcagaggtggaagctggcaaggggggcaggcccggcctgctgctggaagagaaggcggatggtgaggccacgtcccgaagccggcaactgctccagtacctgttctcactctcgcacggcttgagcgccagcagcctgcacaggttccatgagctggagagctgcgctgctcgcctgcacactgccaagtcctccagcgggctggcagggagtatgggcttctgctctgacgagatgggagacgacgatgtctttgaggacagcacatctgcaaaactgaagagtagggttctgcgggcgcccctctgctccacggaaaaggacagcgacctggattgtccttctcccttctctgaaaaattaccccccatatctcccgtgtccacgtcaggggatgtctgcagtgggagaagttgcagatgacgtccagcgagcgcaggaagatcatgtgctcagtgacattccacgtcattgccatcacatgtgtggtctggtccttgtatgtgctcattgaccgtactgctgaggagatcaagcaggggcaggcaacaggaatcctagaatggcccttttggactaaattggtggttgtggccatcggcttcaccggaggacttctttttatgtatgttcagtgtaaagtgtatgtgcaattgtggaagagactcaaggcctataatagagtgatctatgttcaaaactgtccagaaacaagcaaaaagaatatttttgaaaaatctccactaacagagcccaactttgaaaataaacatggatatggaatctgtcattccgacacaaactcttcttgttgcacagagcctgaagacactggagcagaaatcattcacgtctgattgtgtgcgggttgtcattttcctggacatccatgaagagctgaaggaaattgtttactgccaattgtatacctttcttatgtcctttaatagcatagactggacaggtgactatttatagtggcttctctttttctaaaccctccttagtctcctagaaaaccttcctgtgggccaggcatgcctgggtcctgcctctgcctggcagctctgtgggaaagtggaagaccccatgatgacatcatggggagccagcagagttcctgcccatggtcttgagctgaatgagagaataaaatgccaatcccaagggaagaggaggagcaggggtgcccaggccctgatacccagccgcctccagcttgcagtggtccccagcctggagcagagcattggggagtgtctagccatgacgagaagattccctctgcatcacggcgaaccccaggagatggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgct

SEQ ID NO: 1398 - DNA, 2521 bp, Homo sapiens
acacacggagacgtgcgcgcacacccacttgtgcagagacacgcgcacgcagacacatgtgcgcacagagacgcacacagacacacgtgtgcacacaggcaaacaggcacgcgcagagacgcacacagacacgcgtgtgcaccacaggcaaacagacacgtgcagagacgcacacacaggcacacgtgcgcacacacagagatgcaaacacagacacacgcgtgcacacagtgacgcgcgcacagagagacacacgcgcgcacacacacgtctcccccgcgccagctccggctccagcagccttggggtccccgcccagacccgggctcctgactccctcaacgactgcatctcgcggggcgatcccggtcgggttccgcctgagccaaggccccgcacccaaaccgagacagcggatccagtagcccgaggcccgcagctgggcgaaggaaccgggactcaagagtagcctccggcaccgagccctccaagaaaagcagcccgggaccccgacaaccgtggacggagccagggtgggtcatagctcgaggcatcgtcaacggagggtccttaagagactctgaacccattcacccgggcaccagagactctgccaaagcaccaattcgggcaggtggtagcctcgaagctgggaggctgcatctcaagcctcctcctagatccgcggtggaccctgggaaatgtagtccagagcaagccaccacctaaatgcgccgtggaccctgggaaaggtggtccctcgcaagtcaccgcctggacgcaggactctgcacttgtccaagagaagaatccagagaaatcagagcaggtcaaatagttctaaaagccatggcccagggactggtgacattcagggacgtggccatagagttctctctggaagaatggaagtgcctggaacctgctcagagggacttgtacagggaggtgactctggagaactttggtcacttggcctcactaggactctccatttctaagcctgatgtcgtctccttattggagcaagggaaagagccctggatgattgcaaatgatgtgacaggaccatggtgcccagacttggagtccaggtgtgagaaatttctacaaaaagacatttttgaaatcggggcattcaactgggagataatggaaagccttaaatgcagtgacctggagggctccgattttagagctgactgggaatgcgaaggccagtttgagagacaagtcaatgaagagtgctattttaagcaagtgaacgtcacctatggacatatgcccgtgttccagcatcacacgtctcacactgtacgtcagagcagggagactggtgagaaactgatggaatgtcatgaatgtgggaaagcatttagccgtggctcacaccttattcaacatcagaaaattcacactggtgaaaaaccctttggatgtaaggaatgtgggaaggccttcagccgtgcctcacaccttgttcagcatcagagaattcacacgggtgagaaaccttatgactgtaaggactgtgggaaggcctttggtcgtacatcagaacttattctacatcagagacttcatactggtgtcaaaccttatgaatgtaaagaatgtgggaagacctttaggcagcattcacagctgattctgcatcaaagaactcacacaggcgagaaaccctacgtatgtaaagactgtggcaaggctttcattcgtggctcccaactcactgtgcatcggagaatccacacaggggccagaccctatgagtgtaaagaatgcgggaaagcctttagacagcactcacagctgactgtacaccagcgaatccacactggtgagaaaccctacgagtgtaaggaatgcggaaagggctttattcacagctcagaagttactcgacatcaaagaattcattctggggagaaaccctatgagtgtaaggaatgtgggaaggccttcagacagcacgcacagctcacacgacatcagagagtccatactggcgacagaccctatgaatgtaaggactgcgggaaggcatttagtcgtagctcatacctcattcaacatcaaagaattcatacaggtgacaaaccctacgaatgtaaggaatgtgggaaggcctttattcgtgtttcacaactgactcatcatcagcgaattcacacttgtgagaaaccctatgaatgcagggagtgtggaatggcctttattcgtagttcacaacttaccgaacatcagagaattcatcctggtatcaaaccttacgaatgtagagagtgtgggcaggcatttattcttggctcacaactcattgaacactacagaattcatactggttagaaagccttgagtgtaagggataaagataagcctttatgtggagttcacatccggctcagtactaggtaatttttaatgtagtgtaattaatgtcagaaaacacctgtcacttccatcatagaacatcagaaaactcacacccaaagaaaattaaataaatgtgggaattctt

SEQ ID NO: 1399 - DNA, 2101 bp, Homo sapiens
attcgccaggcagagctgagaagcgcaccaggagaaatgaatatgctgggctgtgccagagaataacaaaacccggtggccgtgagcaaaaaagcaatcatgagggtgaaaggaggatgagagacgtgaagaggaggaagagtgggagaatggtgctgaatggggttcggcaggaagtcactggccagaaccaggccaaggtggacatcaccaagcccaaccctctcattgcctgagagaaccccagtttcagactgctaatccgtcttgcccaatgcttcacaggccatgctggggccagaaccccagccctgtgcctcctagcccaggatttgtctcctttagaatgaaggcactcaggagcaaggatgctctgtctcctgtcggttccaggcaagcacagatggttcctactccttttcctctaccccttgctctggcctgcctagcacagttccttccgaggatggtggctcctgctcatccaaggcacccgctgtctctgtaaggcgtggcctctgatgtgaaagtggtggagggcaatggaagggaactgactttactgagtgctcactatgtaccaggcactgtgtctcatgttgattataggccatctctgttcttccccaaattcctcctgtgagcacgagaatctcatttaacaggcaaggaactgaggctcctctgagttcttattcaatataatgataagaagagcaaacacttagaaatcatgtactgtgcactgggcattgtttgaatctttttcagatattaattcatttcatctgcacactgggctgtgaggggaggagtatcatctatcatttaagtagatggcagggggaggatttgaagcctggggtgaccttcgcactgcagtccgctgaccctactgtcctcactgaagagaacggctcaggaagttcaagtcaggcacacaagaatgagctgatgatggactggatgttggaacaggaagccaagtgggatttttccttgtgtctcagaattgcagccagtggccaaagctgacagtgaaaagcactgaagacccagcaatcctgagttcagaaatccacctgcagtggtgccagctcccacctacagacccagggagagatctgtctcccagcaaatgccaagtgctctgcctgccttcccactggcagtgttagttagaagaggcaaggcctcctagggagggcgggggttgtggtgagattcccttgttcctggggtgtctgcagcaagggaggccagtggctggttcccaggctgcgctggtgttcagcgagccgcagacccaaagccagctgtggagctgtggtaagagcctcgggcgcattctgggaatatgtgtctgacacagggcctcccccactgtggggaagaagaggacccatggctggctcccttgacattttggggttcacttggactccgagatcagtgcctacctctggtctagagatttccaaaggcaaaggcctggttgatgtggccttggccagcagggctcagaacaacagagacggatggtgtttctgagaggaacactgggcaatcccacccagtacccattcttctagctctcagagagtccagatgaacaccctagaaggtccctggggtctatgtaaagggtccctgggttctatggaaagggatcctggggttagcacagagcaggtgccgcataggccactggggcaagtaacggcactcccaacccagggagggatttgtgggtgctcatttgctgtcagggctaaaggtagacacagctgccctctggaggagtgtgggactcagctacagagtggaccgtggggagctgaccacgagccccagaaaaccttgtgcaccatctatgcagagaagaccacctcatcagcaccaccagcactggccagaaccaaatgaagccagggacaccagggagagacagagacagagatgacagagacagtatgtggtctgcagcacttgaaatattttctatcagatgtttaccaaaaaagtttgccaaccttatttgtagcctgattgggtgggggtgcagctataaaaaaggtacagcgttcacattttaaattct

SEQ ID NO: 1400 - DNA, 2332 bp, Homo sapiens
atttcccagacggggtggttgccggacggaggggctcctcacttctcagacggggcggttgccaggcagagggtttcctcacttctcagacggagcggccgggcagagacgctccccacctcccagacagggctgcggcccagcagaggcgctcctcacatcccggacagggcggcggggcagaggtgctccccacatctcagacgatgggcggccgggcagagacgctcctcacttcctagatgggatggcggcggggaagaggcgctcctcgcttcccagatgggatggcggccgggcagagacgctcctcactttccagactgggcagccaggcagaggggctcctcacatcccagacgatgggtggccaagcagagacgctcctcacttcccagacggggtggctgctgggcagaggctgcaatctcggctctccgggaggccatgtgtcttgggacaaggtgcgcattcctggtgtgctgcagcgattgggagtgacatactttgtggttgctgtgttggagctcctctttgctaaacctgtgcctgaacattgtgcctcggagaggagctgcctttctcttcgagacatcacgtccagctggccccagtggctgctcatcctggtgctggaaggcctgtggctgggcttgacattcctcctgccagtccctgggtgccctactggttatcttggtcctgggggcattggagattttggcaagtatccaaattgcactggaggagctgcaggctacatcgaccgcctgctgctgggagacgatcacctttaccagcacccatcttctgctgtactttaccacaccgaggtggcctatgaccccgagggcatcctgggcaccatcaactccatcgtgatggcctttttaggagttcaggcaggaaaaatactattgtattacaaggctcggaccaaagacatcctgattcgattcactgcttggtgttgtattcttgggctcatttctgttgctctgacgaaggtttctgaaaatgaaggctttattccagtaaacaaaaatctctggtccctttcgtatgtcactacgctcagttcttttgccttcttcatcctgctggtcctgtacccagttgtggatgtgaaggggctgtggacaggaaccccattcttttatccaggaatgaattccattctggtatacgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactc

SEQ ID NO: 1401 - DNA, 2931 bp, Homo sapiens
attatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatcgctttagttccaccttgctccacaagcagcacaaccacactggttggtgagaatgtatctgaagaagaggctcagggagtaaatgggaacaggccagcaaaacactcagctgcaagtccaaagccacaagtgcctccaaagccattacacctgcagaattcaccttcgtccaatatacaccaaacccccaggcataaagctttacctagtgcaaaaccaaggatggaggaaattaaacctgcctctgcttcttgtgtctcaaaagaaaaacccagtaaggtatcagatctcatcagtcgctttgaaggaggcagctcattatcaaattatagtgatttgaagaaagagtctgctgtgaacctaaatgctcctagaaccccaggaaggcatggattgacaaccacacctcaacaaaaactcctctcccagcacttgccacagaggcagggaaatgatgcagataagactcagggtgcacagacttgtgtggccaacggtgtaatggcagcacaaaaccagatggaatgtgaggaggagaaagctgccactcttagctcagatacttctattcaagcttctgaacccttgcttgatacgcacatagtgaatggagaaagagatgaaactgccacagctcctgcatcacccacaacagatagctgtgatggaaatgcttctgacagtagctacaggactccaggcataggcccagtgctccccctagaagaaagaggggcagaaacagaaaccaaggtacaagagagggaaaatggggaaagccctctggaactggagcagctggaccagcaccatgagatgaaggagactaatgagcaaaaacttcacaaaatagccaatgaacttttgcttactgaaagagcttatgtcaaccgacttgacctcttagatcaggtattttattgcaaactgttggaagaagcaaaccgaggctcgtttccagcagagatggtgaataaaatcttttccaatatttcatcaataaatgccttccatagtaaattcctcttgccagagctggagaaacgaatgcaagaatgggaaactactcctagaattggagacatccttcagaaattggcaccattccttaagatgtatggagaatatgtgaaaggatttgataatgcaatggaattggttaaaaacatgacagaacgtattccccagttcaaatcagtggttgaagaaattcagaaacagaaaatctgtgggagcttaactttgcagcatcacatgctagaacctgttcagcggattccccggtatgagatgctccttaaggactatctaaggaaattgcctcctgattccctggactggaatgatgctaaaaaatcacttgaaattatatctacagcagcaagccattctaatagtgcaataaggaaaatggagaacctaaagaaactcttagagatttatgaaatgttgggagaagaagaagacattgtaaacccttcaaatgaactaataaaagaaggacagatcctcaaactagctgctcggaacacttcagcacaagaacgctaccttttcttattcaacaacatgttgctgtactgtgtgcccaaattcagcttggtaggctctaaattcacagttcgaaccagggttggcattgatggaatgaaaattgtagagactcaaaatgaagaatatccacatactttccaggtgtctgggaaagagagaacactggaactgcaggccagttctgcgcaagacaaagaagaatggatcaaggcccttcaagaaaccatcgatgcttttcatcaaaggcatgaaaccttcagaaatgcaattgcaaaggataatgacattcactcagaggtttctactgctgagctagggaaaagagccccaagatggatccgagataatgaagtgacaatgtgtatgaaatgtaaagaacctttcaatgcactgacacgaaggaggcatcattgtcgagcatgtggatatgtggtttgttggaaatgctccgactacaaagctcaacttgaatatgatggtggtaaattgagcaaagtttgtaaagactgttatcaaatcataagtggattcacagacagtgaagaaaagaaaagaaaaggaattttagagattgaatcagcagaagtatctggaaacagtgtggtgtgcagctttcttcagtatatggagaagtcaaaaccttggcagaaagcttggtgtgtgatccccaagcaagaccctcttgtgctgtacatgtatggtgccccccaggacgtcagagcccaggccaccattccacttctgggctatgtggtggatgaaatgccaaggagcgcagacctgccacacagtttcaaactgacccagtctaagtccgtgcacagctttgctgcagacagtgaggaactgaagcagaagtggctgaaagtcatccttttagctgtcacaggtgagacaccaggtggtccaaatgagcatccagccaccttggatgatcatcctgaacctaagaaaaaatcagaatgctgaactcctccaggaccagccatggtgtggaggtctcaggacttacagctcaagacattcccagctcttcttacacatctgctagcactttatgttgaaaaatataggcccataaatgcatcttttgaggactattttcctatgtttatgtactcttagtgaaattagtgtgcagagtcattctaccgataaagttttgaaataatgtg

SEQ ID NO: 1402 - DNA, 1374 bp, Homo sapiens
gttgctaggtaaccacatctcccataactgccccagcacatcgtcctgagccgcccaacctgtctccagccaccttctgtggagtctcaaactccatcatctgtgggaccctgtaggccgaagggagaaacaagagtgcagccaccacccctgagccacctgtggctctgctacccacaatttcactgtgaagagtcagctgcctgggccgtgaggtcactgccaccatgagtctgggcatcatggaagaggaagacctggccgagtacttccggctgcagtatggggagcggctgctgcagatgctccagaaactccccaatgttgagggggcgtcggagtccctatccatctggctactggagaagaaaaaggagacagaaatcatgcatcaaactatggtgcagaagaagaagatgtttcagcgcagaatggaaaccctgaacctgcgctgggaggaactgggcgttaaggaagcccaactgaaggctcacatccagaagtctgagcagttcatccaggagaacgaccagaaacggatccgcgccatgaagaaagccaacaaggagcgagaactcaagtgccagcacatgcaggagctgaccaagcgcaagcaggagatggtggcgctgcggctggagcaccagcggctgagcgccaagctgaaggactactacatcttcaacaagtacctagagaaggtggtggagaactccgagttcgaggagatccatgaggtgattgcacgctacaagacgctggtgagcatgcgccacgacctcatgcagtctgcgcaggaaggccaggagaagattgagcgcgccaaggcccggctggcgcgctacatggaggaaaaggatgatgagatcctgcagcaaaacaatgagctggcaaggctgcagatgcgctttgaccgtgcccgcagcaatgtcatcttctgggaatctcgctgggcgcacatccagaacaccgcagccaagaagaccctcctgctcggcaccattaagatggccacgctgaacctcttccagatcgtgagcaagcacctgaaggaggtgactgaggtggcactggaggacacccacaagcagctggacatgatccagcaatttatccaagaccggtcggacatctgggcagaggtgaaaaagaaggaacaacagcgagtccggatttaaggaggcagccttgttccagaatgtcctgagacagagatcgtgaaagaagaagtcgtgagcctgcggtccagtcagtccagctcgggaccgatgcctgctgtgccttcctgctgagggacacctgcttattttcccccgtgggcctcactctatccctgaaaacagtgaatgttatatgaagtttgttctcaagttc

SEQ ID NO: 1403 - DNA, 2146 bp, Homo sapiens
gtttcaactcttgcttgaatcaagaacagaagcctctctttagacaggacttatccagagggggctgcaggcgagcactctcgtgccccgccggagcgacccggctcgtgccgggagcggctgctcgtagacgtccgaggagcctgccgagtgccgtcccggcgcccgaccgcccacccatcggcccgctggcccggttcttcctgatgcagactgccgtccactagaggctggacaggaccccccgaggtgattcatggcaggggacgtggaaggattctgttcctccatccacgacaccagtgtctctgctgggttcagagcactgtatgaggagggattgcttcttgatgtcactctggttattgaagatcatcagttccaggcccataaagcactcttggccacccagagtgattacttcagaattatgtttactgcagacatgagggaacgagatcaggacaaaattcatttaaaaggtctaacagctaccggtttcagccatgtcctgcaatttatgtactatggaactatagagctgagtatgaataccgttcatgagattcttcaggctgccatgtatgttcaacttatagaagtggtgaagttctgctgctcttttctcttagcgaagatctgcctagaaaattgtgcagaaattatgagactcttagatgatttcggcgtaaacatcgagggagtcagggagaagttagacacctttctgctagacaactttgtgccactcatgtctaggcctgactttctgtcctatctgagctttgagaagctcatgtcttacttggataatgatcatctgagcaggttcccagagatagagctgtacgaggctgtgcagtcttggctgcggcatgatagaagacgctggagacataccgataccatcattcagaatatccggttttgcttgatgaccccaaccagcgtttttgagaaggttaagacatcagaattttatagatactcccgacagctccgttacgaagttgaccaagcattgaattactttcagaatgttcaccagcagcctttgttggatatgaagtcaagccgcatccgttctgcaaaaccgcaaactacagtatttcgaggaatgattggacatagcatggttaacagtgaaatacttctcttaaagaaaccaagagtctggtgggagctagaaggcccacaagtacctctgcgacctgactgccttgctatcgtcaataattttgtgttcctgttaggcggggaagagctgggcccggatggtgaattccatgcttcttccaaagtattcaggtatgacccgagacagaactcctggctgcagatggcagatatgtctgtaccacgctctgaatttgctgtaggtgttattgggaagtttatttacgccgtagcaggcagaaccagagatgagactttctattcaactgagagatatgacatcaccaacgataaatgggaatttgtggatccttatccagttaacaaatatggacatgaggggacagtgctcaataacaaattgtttatcaccggtggaatcacctcatcttccacctccaagcaagtgtgcgtgtttgaccccagcaaagaagggaccatagaacaacggaccaggagaactcaagtggttaccaactgttgggagaataagagcaagatgaattacgcgagatgctttcacaagatgatttcttacaatggcaagctttatgtcttcggtggtgtctgtgtgatcttgagggcctctttcgaatctcagggatgcccttctacagaagtatacaacccagagactgatcagtggaccatcttggcatccatgccgattggtagaagtggccatggtgtgactgtgctggacaaacaaataatggttcttggaggcctttgttataatggtcattacagcgattccatcctcacttttgatccggatgaaaacaagtggaaggaagatgagtaccctcggatgccctgcaagctggatggtttacaagtatgcaacctgcattttccggactatgtactggatgaggtcaggcgttgcaactaatgacatcctcctccctaaaaaaagaggcaaacaaagtatttgtttgcacagagtaattaattaaaacatataaag

SEQ ID NO: 1404 - DNA, 2696 bp, Homo sapiens
acaaacctgaaacgaaatctttgcaaccagtacagcctgcgcggggcgcggcccagtccatcccccttcggatgcgcagaagcagaggtcaccacgccggacccctcgattccctcgcgggcgattcctggctccttcaccaccccagcactccaagacccccgccctttggcctgaggctcccactgccctagccagttcccgggctcacttccagcttttccagaaagcttggccacgcccctcggcccagactctcaggccactcggccgcaattaacccgcgtctctgcgcctttttaggcccctccccctcggtcgtgcccttgtcatctcttaggccccgtctcaccctttcggatgcctcccctagaaccctaccactttccacccctttccgtctgttatttctcccaaacttgcgcccgcacaggcccctctggaacactcctgccccgtagtgcccctcgtccccgctccgtagagaaagagcgtgcgtgccgcgcatttctggcctggggagcgggtggagtaaacctgcgggaaccattttacgacaacgtgcggctgtgcggtgtggctgacggcaacgccgctgctcttggagaggtcactccggagacggcgttggttttggggtgtggggggttggtggcactatgtggcgcgtctgtgcgcgacgggctcagaatgtagccccatgggcgggactcgaggctcggtggacggccttgcaggaggtacccggaactccacgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttgggaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagtgccaccacctaccccacccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttatttt

SEQ ID NO: 1405 - DNA, 1968 bp, Homo sapiens
taattctgatgtcattgattttgtaaatgtgtgtcgattttagaaatgtactgatgctgttggtacaaggaagtttatatctgatttatgtttgttcatagttaagtgtaatatgttataagcaatgtttaagtcaactctggaattcacaggattctttttttttttttttttggagacggagtctcactctgtcaccctggctggagtgcagtggtgtgatctcagctcactgcaacctttgcctcccgggttcaagcaattctcctgcctcagcctcccgagtagctgggattacagacatgcactaccacacccggctaatttttgtatttttagtacagatagtactgtgctggccatgctggtctcgaactcctggactcaggtgatccgccttcctcggcctcccaaagtgttgggatgacaggcgtgagccactgcacacagcctcacaggagtctttaataaggtctacatgttaatcaagtatgagaaatattctaatgggacttgaaatcctcaagaactatataggacggaaaacataagtgtttcatttctcaatgtgtatttatctcctctgtcatttaaattgagggcataacactatggaaaaagtaaatgttaaatctcccaatcctaaacaaggaacgtctgtgttattttcccacagaagaaactcttctcgccctttttcctatttttcattcattcattcattcattcatttactcattcattccttcacttaaacttttttttttgtatccactgtatgcccaggactgcacgaggcactgagtacttagaaatagtctcctgccaaaagtccaagttgcttggctggtttccctctattcagaaggtgatgacatcagtgaggatataaagtagcaagaatcacgaggtagatggcctgggtccagatctcagtggtggtcagaaatcaaacagaccagctacactcagggagtttccacccctctaccacagagaagtgacgccttcatgccttcttttgcaaggttgaattgtgccaaaactttcttttgtagtccagcatcaataggactgccggtccctgtcagatgacctccaagctccttccgctcttactacactgtgggctgtgattgatggaggagggtttacaaacgtggaggcctccagagccaggcaggtaatgctgacccagtgatgtggagtctacggccagtaagagcctctgctttatatgctgggaggaaagccacttctcagctcagccacttttcagctctggacagcagctgccatgcacgatgcaggtccaaatgttgacagtgatgctgggttttaagtgcaaatttccaattttgcatagctaaagagacagtatttccagtgtgcaacctgtgaatgtgccctggttaattcaaatgttaggtttgatctcattttgaaggtccctgttgattcgagcatgttgttccatgacatcctaacttagaactttaatggtgttacttatttcccttctaagtttgtgggatacccttttgacccaatgacagtttatctttactttcttgtttgctcttagatgttattgtactttacagagttatctcactcaggctcaacagatgttgttgtataatattttctacttccaggttatgctgccctaatgggtatgtcctaggggaggagggctaagctgtgaatgcattgggatgtccaggatacctatcactccgatatttttctttctcttcatctgaagctggaagtacttggctgtcacagtttttaagatgtgtgaaaagtcaattggaatgaaatgatttgtaataaaaaataagggaatttagttataagaggtcatattttctggtattgtagtattgttttctttcattgttggaattctttgtcccttaggcaaaagttgtattttagggctaagaaatttgaacagccacg

SEQ ID NO: 1406 - DNA, 2563 bp, Homo sapiens
gattggcgggaagatgggacgatgcgttacgtgcggagatgcgtccccctccccggcgctcctgcgcgcgttacagatgtagagctaaaacgactgaaggatgctttcaagaggacctgtggactctcatattacatgggccagcactgcttcatccgggaagtgcttggggatggagtgcctccaaaggttgctgaggtgatttactgttcttttggtggaacatccaaagggctgcacttcaataatttaatagttggacttgtcctccttacaagaggcaaagatgaagagaaagcaaaatacatttttagtcttttttcaagtgaatctgggaactatgttatacgggaagaaatggaaagaatgctccacgtggtggatggtaaagtcccagatacactcaggaagtgtttctcagagggtgaaaaggtaaactatgaaaagtttagaaattggctttttctaaacaaagatgcttttactttctctcgatggcttctatctggaggtgtgtatgttaccctcactgatgatagtgatactcctactttctaccaaactctggctggagtcacacatttggaggaatcagacatcattgatcttgagaaacgctattggttattgaaggctcaatcccggactggacgatttgatttagagacatttggcccattggtttcaccacctattcgtccatctctaagtgaaggtttgtttaatgcttttgatgaaaatcgtgacaatcacatagattttaaggagatatcctgtgggttatcagcctgttgcaggggacccctggctgaaagacaaaaattttgcttcaaggtatttgatgttgaccgtgatggagttctctccagggttgaactgagagacatggtggttgcacttttagaagtctggaaggacaaccgcactgatgatattcctgaattacatatggatctctctgatattgtagaaggcatactgaatgcacatgacaccacaaagatgggtcatcttactctggaagactatcagatctggagtgtgaaaaatgttcttgccaatgagtttttgaacctccttttccaggtgtgtcacatagttctggggttaagaccagctactccggaagaagaaggacaaattattagaggatggttagaacgagagagcaggtatggtctgcaagcaggacacaactggtttatcatctccatgcagtggtggcaacagtggaaagaatatgtcaaatacgatgccaaccctgtggtaattgagccatcatctgttttgaatggaggaaaatactcatttggaactgcagcccatcctatggagcaggtcgaagatagaattggaagcagcctcagttacgtgaatactacagaagagaaattttcagacaacatttctactgcatctgaagcctcagaaactgctggcagcggctttctgtattctgccacaccaggggcagatgtttgctttgctcgacaacataacacttctgacaataacaaccagtgtttgctgggagccaatgggaatattttgttgcaccttaaccctcagaaaccaggggctattgataatcagccattagtaactcaagaaccagtaaaggctacatcattaacactagaaggaggacgattaaaacgaactccacagctgattcatggaagagactatgaaatggtcccagaacctgtgtggagagcactttatcactggtatggagcaaacctggccttacctagaccagttatcaagaacagcaagacagacatcccagagctggaattatttccccgctatcttctcttcctgagacagcagcctgccactcggacacagcagtctaacatctgggtgaatatgggaaatgtaccttctccgaatgcacctttaaagcgggtattagcctatacaggctgttttagtcgaatgcagaccatcaaggaaattcacgaatatctatctcaaaggctgcgcattaaagaggaagatatgcgcctgtggctatacaacagtgagaactaccttactcttctggatgatgaggatcataaattggaatatttgaaaatccaggatgaacaacacctggtaattgaagttcgcaacaaggatatgagttggcctgaggagatgtcttttatagcaaatagtagtaaaatagatagacacgaggttcccacagaaaagggagccacaggtctaagcaatctgggaaacacatgcttcatgaactcaagcatccagtgtgttagtaacacacagccactgacacagtattttatctcagggagacatctttatgaactcaacaggacaaatcccattggtatgaaggggcatatggctaaatgctatggtgatttagtgcaggaactttggagtggaactcagaagaatgttgccccattaaagcttcggtggaccatagcaaaatatgctcccaggtttaatgggtttcagcaacaggactcccaagaacttctggcttttctcttggatggtcttcatgaagatcttaatcgagtccatgaaaagccatatgtgg

SEQ ID NO: 1407 - DNA, 1962 bp, Homo sapiens
aaaacaggaaggccacagtggaggccaagccttccccatgggcaccttctcagattgcgattgtggatgaaatgagggattttcttgaaacaaccctcacgcaggtgacgcaagacgcggagctcggctgcacgacgctggcgcaagcgcgggggcaagagcgccggcctccgagacggtgagaaaatggctagcaacaatcattggtttcagagttcgcaggtccccagctttgcccagatgctgaaaaagaacctgccagttcaaccagcgacaaagacgataactacacccacaggatggtcctcagaaagttacggcctgtccaagatggcatccaaggttacgcaagtaacgggtaattttccagagccgttgctttccaagaatctttcatctatttcaaatcctgtccttcctccaaaaaaaatacctaaggaatttataatgaaatacaaacgtggagagataaatcctgtgtcagccttgcaccagtttgcacaaatgcagcgagttcagcttgaccttaaggaaactgtgacaacaggtaatgttatgggaccatattttgccttttgtgctgtggtggatggtattcagtacaagactggactgggacaaaataaaaaggagtctagatccaatgcagcaaaattagctcttgatgagcttctacaactggatgaacctgaaccacgaattttagaaacatcaggtcctcctcctttccctgcagaacctgttgttttatctgaactagcatatgtttcaaaagtacattatgaagggagacatattcaatatgcaaagatttcacagatcgttaaagaaagatttaatcaactaatttctaatcgttcagaatacctgaaatatagcagttcattggctgcttttataattgaaagagctggacaacatgaggttgtagctataggcacaggtgaatacaattacagccaggacattaagccagatggaagagtattgcatgacactcatgctgttgttacagcaagaaggtctcttcttaggtacttttatagacaacttctgctcttctacagcaaaaatcctgctatgatggaaaaatcaatattttgtacagaaccaacttctaatctactcactcttaaacagaatatcaacatttgcctttacatgaaccagttgcctaaaggatcagcccagattaagtcacagttacgtcttaatccacattctatatctgcatttgaagccaatgaagaactctgtctccacgtggctgttgaaggcaaaatttatctgactgtttactgtcctaaagatggtgttaatagaataagcagtatgtcctcaagtgacaaattgaccagatgggaagtgcttggtgtacagggagcattgctgagtcattttatacagccagtttacatcagcagtatacttattggtgatgggaattgcagtgataccagaggcttagaaatcgctataaagcaacgtgttgatgatgcactcacttcaaaacttccaatgttttacttagtcaacagacctcatattagtttagtaccctctgcatatccccttcaaatgaacttggaatataaatttctgagtctgaattgggcacaaggagatgtttctttggagattgtggatggcctgagtgggaagatcactgaaagttccccatttaaaagtggtatgtcaatggcaagtcggctttgtaaggctgcaatgttaagtcggtttaacctgcttgccaaagaagctaaaaaagaattacttgaagctggtacatatcatgcagctaagtgtatgtctgcctcctatcaagaagctaaatgtaagttgaaatcctacttacaacaacatggctatggatcctggattgtgaaatctccctgcatagagcaatttaacatgtgaaataggcaatccattatcacattaaaaatcttgttttgtttggtg

SEQ ID NO: 1408 - DNA, 1944 bp, Homo sapiens
agaggaaggcgaatgactcgagtctatggttttggtatactgagcctggggctactggtgtcagcctggtggtagtgcagctcatctgatgcctggggctgcaggatcctagttggttcctgtgacagaccttgggaagctcaatctcaggtaaagcctggagtctggggtcataggggcctgcccagtactgggttttaatgaggcacgtccagtgttggacctcacagcaaagtgctcacttccctcttcttccctcaagcagaaagtttctccctccatgttgcgctgccggaggttgagggaagcttttcttaattgtgtcttttaaaaatgtatgtgctatacccaggtgctgtaatctcttccttggtttcccaatctcttgtaaaggtttttttgtgcatgaataattgttcaaatggaagtttttttgcagaaacaagtgcaggaaagtcctattttgccattttgctgatgtctctccccagtatggtccatttaaaacagaaatcacgtcatgtctctgctcaaaaccctccagcagctccattttattcagaacaggtcaaggtttaccatggcctgcaagaccctacatggttttcatcccctaattctctgatttcatcttttgtgtactccttgttcactctgtcccaggcacattggctgttgctcacaaacacgaggcattttagggtctttgcacttgtgtcttgcctgagggtctttgcactagctgtttcctctgcctagaacatccttacacaagagtattgtgtacttcccttgtgtctgtctttctcctatcctttgtgtctttgctcaagtcccacctccccaagatgcctactcctgaccactgtatttaatactgtaccttgttctcagcatagccagctctcctgatttccctaactctgctctatttggtttcttttttttactacagcaatcatcagttgtaacatgctagatcatttatttatttactgtatgtatttttcaatgtctaccttatcttagtagaatgtcaactccaggaaggcagtaaattttgcctagttttttcactgatatatcccaaacaccttgaaggtgtcctaacatacaataaacactttataaaagtatattgaaaacattagccaatgtttgttaatgaagtccgtatatctatgatgtaaaagtgtatatgtatgcatatgcatatgtatgtatagaatggttttaatgagttaaacttctgtgagtaaacatacttgattgttagtgtaacatgaaaattgcaaagtcagaattttctaaatgaaaggtcataaagcttctttagtaaatgttaatttgtttcaaagtattttaatagtgatataaaatcctagatgtgttcaattgggttgagataatgatattggagaaaaattataattttcttgatgcccaagcccttccatctttaattttaatacttacggcacttcattaaaatgcatgctgtatttaattttccaggaaattgtacagcataaaagaagaatgtatattcaaagcaatttccagtcaaactagttgaaacttttagaatataagccaatagagcctgtgtcttttctagatgtgaggctgttcttggcacatttgcaggggtcagtgtagcttctgagctacctttaacccttgctcggtgcacctatttcctaagacctttatcacattctgtaccctttccaaattgccgataccaatttcaaatccccagggcagacataatattctcataatatctgaccactgctaacagctgtgggaagaaaacttgctgtttttagagcctctgcttcagtgtacatatcccattttcatccctcgtttcttaaaagaattatattgctgacaaatttaactttgagtccataataaatcttggaaattttttctggc

SEQ ID NO: 1409 - DNA, 1588 bp, Homo sapiens
taagtcaagtgagcgggatcgcttgaaagctgagtgggaccagcacaatgactgcaagattttggacagccttgtgcgagcaagaatcaaggatgctgtgcaagggtttatcattaacattgaagaaagacgaaataagctacgtgagcttttagcattagaagaaaatgagtattttacagaaatgcaattgaagaaagaaaccattgaggagaaaaaagataggatgagagagaaaactaaattactaaaagagaagaatgaaaaagagaggcaggattttgtggctgaaaagctagaccagcaattcagggaacgctgtgaggagctccgtgttgaattgttatctatccatcagaagaaggtgtgtgaggagcggaaagcacagattgcatttaatgaggagctgagcaggcaaaagctggtggaagagcagatgttctccaaactctgggaggaagaccgattagccaaggaaaagcgagaagcccaagaggcgaggagacagaaagagctgatggagaacacacgcctggggctgaatgcccagatcaccagcatcaaggcacaaaggcaggcgacacagctgctgaaggaagaggaggcacgccttgtggaaagtaacaacgcacagattaaacatgagaatgaacaggatatgctaaagaaacagaaggcaaagcaggaaactaggaccattttgcaaaaagccctacaagagaggatagaacatattcagcaggaatacagagacgaacaggacttgaacatgaagctcgtgcaaagggcccttcaagacttacaggaagaggcagataaaaagaaacaaaaaagagaagatatgataagagaacagaagatataccataaatatttggcacagagacgtgaggaagaaaaagctcaggagaaagaatttgacagaatattagaggaagacaaggcaaagaagttggctgagaaggacaaggagctgagacttgaaaaggaggcaaggagacagcttgtggatgaggtcatgtgtacaagaaaacttcaagttcaagaaaagttgcaacgagaagctaaagaacaggaagaacgtgctatggaacagaaacacataaatgaaagtcttaaagaacttaactgtgaagagaaggagaattttgcaagacgccaacgtttagcccaggagtacaggaagcaacttcagatgcaaatcgcctaccagcagcagtcccaagaagcagagaaggaagagaaacgccgagagtttgaagcaggtgtagcagcaaacaagatgtgtttggacaaggtccaggaggtcctgtccacccatcaagtgctgcctcaaaacattcatcccatgcgcaaggcatgccccagtaagcttccaccgtagttccgtgagcatcaatatatcttttcttggtcttttaatatttttaactacagtatgcttgtatgcttcttttaactcctggataaacttttcttttttccctgagtttgtgtaattaattgaacataattttcttcctttgaataaacctgtgcctattttggagttcacagacttacaaatccaaaaaaaaaaaaaaaaaag

SEQ ID NO: 1410 - DNA, 1954 bp, Homo sapiens
gattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccacggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggtctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagctcctaggacagcaccttcaggagtaataatgcaggcagtagctggcaattaaggaggcactccatggtgggtcatgaaggaatgaatgagtgagtgatgagattaaacctcgttgatgaggaaaagaactcgaagtccagcacaagtaaccaaagatctcaccgagtaatcacagtgacaactgttatgtcaaattcaaatccattaccctctgaaaacagttaggaaattctattctccgaagggttcgttcctttcttgatgtgtcacttatcattatttttaattccttctagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaatt

SEQ ID NO: 1411 - DNA, 2196 bp, Homo sapiens
gtagcgccgcgggtttgatgaacgcggttcccggggagactggtacggttgctgtgtgctatggagccgagggtcgtcaagccaccggggcaggatttagtagtggagagtctcaaaagccgctacggactcgggggcagctgccccgacgagtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagcacgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaagcttttgcctctaatgacagagcagctacagtggatgccatttgtgaatatcaaacttcacgagccttttgtaaaatttatatattggtccctaaggcagctagatgctggagcacagcactcgactatgacatcaacattgaggagattgggtgaagacatttttaaaggagtggtaactaaaggaattcaggataattctccacagcattctgtggagaataaaccaaagacagctgctttctttaagagctccaatttgccattgagatttttatcaaccttaattgttctcaaaacagtcactcaagctgattacctggctcaggcatttgattctctttgtttggacttgaagacagaagaaggaaaaaccttgtttttggagtatcaggctgttccagtaatattaagtcatctaagaatatccagtaaaggactcctgtctaatgttattgatagtttgctccagatgacggtggaatctaaatccttgcagcctttcctggaagcctgtagcaactctttattttttcgtacttgctctgtgctgcttcgagcccctaagcttgatcttcaaatactagaaaaactcagtattattttacagaaactttccaaaatcaagagtaataagaagctctttgaactttttacgattcatctgatgcttcaagaaatacaaaggacaacaaacccagagcatgcatttctctgtattaatctaaattcaactctgttcaatctgggtttaacaaaatgtaactccctggtctccagtgcaagcccttagactggctaattttttaatatagtatatgtggtgcttatttataaacatgtagaaattaccaaagtaactacaattctaccaagtaaagttatcagtagcatcatttatcatgaaaaataaataatttttttgaactgt

SEQ ID NO: 1412 - DNA, 2077 bp, Homo sapiens
aatccagaccacgtctggcaggccccaaggcccaggcagctttttgagagcccctctcctgcctggcctggggacatgagccattcacaacagaggagagttggccacaaaaagagagaccacaatctaaatgtccagcaatagaagaatggcgagatacattatgaaacacacagaaaggaatgaggcagtctgtaccaagtgatggagaacggtgtctggaatattttgttgagaaaaagcaatctggaaagaatcacattttaatattttttaatgatttgtacaagcatgtacttgtatacatacaacagtatgtctggacatttgtctgctgaaaaagtacttgtttcctctgcggaaggaggggcaggcagtgaagagggaacttctactttgaattcggcacatgtctggttttatgaacaagcatgtactccttttgtgacttttaagaatcagtacaaattttttcaaaggagatagaatgtgacgaaaagcacacccagcaggctacccagaggtgcatgtgttccctaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccaggcagtgcttcctgagcagaccacccggactgtctttcctccacccgcccatggagaaagagcacgcccggccccgccctgtgctcacctctgcctggctcagcgaccttctcaggcattctgccctcctgggcccctctctccctgaaggggctttgtggcatctctggaagagcagggtgtgctgcactcatgggcctggtctcactccttggacttgtcaccttgtgacatttggcttatcagcatttgagaaggctctgctgggtctccatggtgggggtctctcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgcacac

SEQ ID NO: 1413 - DNA, 2323 bp, Homo sapiens
aacctccctcaatcttcctctcatccagtatcaccttcttcccaccccttaagtccgccccttttccccgcccttcctcgccattgtgggcagagacatgaccgtccacgtgatgccgtgctcccgccctcctcccgactgaggaggaagagcagagaggggagggggcgcgagctctcacccctccagtgccgacggtagcgaaagactttcctccaggggctccctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagcagggttgaatgcaccctcaggcacgaccatggagaaaggtgggaacatacaattggagattcctgacttcagcaactctgtcctgagccatctaaaccagttgcgcatgcagggccgtctctgtgatattgtggtcaatgtgcaaggacaagcctttcgggctcacaaagtggtgctggctgccagctccccctatttccgggatcacatgtccttgaatgagatgagtacagtctccatttcagtcatcaagaaccctactgtttttgaacagctcctttctttctgttacacagggcggatatgcctgcaactggcagatatcatcagctacctaacagctgccagttttctgcaaatgcagcatattatagacaaatgtacacagatcctggagggcattcatttcaaaattaatgtggctgaggttgaagcagaattaagtcaaacaaggacaaagcatcaagagagacctccagagtctcgcagggttacaccaaatctcaaccgctcccttagcccacgacataataccccaaagggaaaccggcgaggtcaggttagtgctgtgctggatatcagagagctaagtcctcctgaggagtccaccagccctcagatcattgaaccaagttctgatgtagagagccgggagcccattcttcggatcaaccgagcaggacagtggtatgtggagacaggagtggcggaccgtgggggtcggagtgatgatgaagttagagttcttggagcagtacacatcaaaactgaaaatctggaggagtggcttgggcctgagaatcagccttctggagaagatgggagtagtgcagaggaagtaacagccatggtgattgataccacaggccatggttctgtaggacaggaaaattatactttagggtcttcaggagccaaggtggctcggccaacaagcagtgaagttgacaggtagaagagtcagcaatgatgggagtaagtggctatgtggagtatctccgagagcaggaagtatctgagcggtggttccggtacaaccctcgtctcacctgcatctattgcgccaaatctttcaaccagaagggaagcctggaccgccacatgcgcctacacatggggatcacaccattcgtctgccgcatgtgtggcaagaagtatacccggaaagatcagctggagtatcatatccgcaagcacacaggcaacaagccctttcactgtcatgtctgtggcaaaagtttccccttccaggccatcttgaatcagcactttcgcaaaaaccaccctggctgtatacccctggaggggcctcacagcatctcccctgaaacaactgtcacatctcgaggacaagctgaggaagagtcaccttcacaggaagagacagttgctcctggggaagctgtccagggctctgtgcccaccactgggccagactgaaacatccagggggagggggctgaccctcttcccctatgagccataagcagccagcatcagagccatgggctgatacttagattcacaaaatgccacatcactaggccagaagatgctcccaagatgttgccaaactggaggatcagcaacttacacaaaagcactaaaggctcctcccttcttattgcccgcctcacactttggaaaataatcaagcaaatcaactttctaattcagggatcaacagccttggtttgttaactttataagaaaaaaggttttttaacaaaacgatgatgataaatggtcatttatctatcagtcatgtttgaacactgtactttggtccatatcatcttggtggctataattgcccggatctaaaaaatgcagcaggagcctcaaccatccgaagcagccaaccgcaagagaggaggtagtcatgatggtgatgaggaggagaaatttctcctcttccttccctggcataacatgcatttttgtgtttcaag

SEQ ID NO: 1414 - DNA, 1711 bp, Homo sapiens
aaattcattgcatagagaaaacaatcctgcagacaagcgttttcccttctcataaccccacctaaccttatagcgttctacagaactgagtagtaacacgtacgcgtactaacttattgtgcgtatgtagttttacatagctgcaagcaatgaaggtgtcctatcatgttttcacatctacatttatcagtacagtttggaaagtcttggatgatagatttgaacgaatcctcatggaacatgcagcccaactgtctcatcgtacagataatgtaaggttaagaaaacaagagggccttgtgcaagatccaggcacgagtgcaggactctgccagggccagagccaggccggggatgcctcaccaaggttctgacagcagagaaaggtccaagggtagggtggcatttctcccacttctctcacagaatttcactgtaacgtgactttacttatacaaacaggacagccagccagtgtaatccccccagacatcaaaaagtgtgggctttccatggcacagctagaggctgtggggtcctcctcattctggcagcacgttcatgagtcctgctatgtgccaaattatctgctgggcaccacctaccctgatccgtccctggttcctgcagctcatgcagttacactcttaagagccaggtctttcatgtaactgctgcactggacaccatgcccccaacacaagtctagacaagacacactgaaaagccacacctgcattggaagagcttgcatcaaatgggaccttaattgtatgaggacacaaccatctgagaacgcacaatatgtcgtcacacgcagaccacagggtgtgcaaccactgcagggaaggaggtgtggctggactgtgggggctgcctggctaggtccccagtccacagaatacccatgtggccacagatggagccccacccaccttctcccacacctgtcctccttctggggcatggcactcagcacatggagggtgccgcctgctcatctggctggaagtcatgagaggggaagggccccatttcattaattaccctccttggcaacaacctgtcactgagtgaatgggatggatgtttggggctttcagatgtctgtgcagctgggcccctggggcatggctgaggtggcagccttgactgaatgccctgtgactggacagatttggtcccagccaggctaatcaatgagaaatcccgctggaagcctagacaggatgagactgggtggatgtggatgggatgcacctctcctcacatccctgagtgtccgtggcagctttggcccagactgttttccagaatgcctgcgtggcgagcagcctggggctgcgactggtttctccctcttggccagagagaggatgtgagccgggtactaaggatgccgtctcctctgggggcagagcaacacagcaccaaccacagcacgccaccgtggcaggcttgtaagtgacagagatgacataaggctgatggcaggacgcacagagaggacacgtgataccacgccacttcacaccagggacctcggcgtctgcaggaggtcctgggaccaaaccacaggtactgaaggtcggctgtacctgagattaggagaagctgaaaaggaagctgctatattaagtaagagaattctatcatcaacacacaataagatacgagacttacaaataataaaaatgtcagggttcgaggg

SEQ ID NO: 1415 - DNA, 2048 bp, Homo sapiens
atgtaggcgttccgagcggcggcggaggtgagcgcactgacgagcgggagggacccttctccggcctgatgcgacccggaaagggaacatcacagaaaggtgaagaaatttgccctaaatcataaaactttgtaagtggcagaacaaggatttgaggctggcagtctggttccagagatggggttttactatgttacccaggctggtcttgaacttctgttctcaagagatccacacacctcagcctcccaaagtgctgggattacaggcgtgagtcacttcacctggcccatactggctgctttccaccagcgatggagcgtggggacagtactgctgcaagtggatcgtgggactcctccatcaggtgcagtgtgaggtcctggggacacttgctgtgagtaccctcagccagctcagagttctaccgaagagactgacaagtacacctgcagtgacaacacctcagtgtcagcggatacggcaaagcccttctgaaaaacaaacatcgggcaatgattgtgcaacacagctgctaaaaatccttcatttctggctactccggtctctgagggaagcaccctgccctggggaaattctcacatggccagacacagacctggctgaccagctgcaggctggtgctgacagttccagcacaccttggcttcctcaagagatccaaaggcaaagtctccccggtaatctcttggagtggccctcagaagaacagatgaaaagtctgcctggtttactcttgttgggagcctgagagttcccgtggcattgtccttggctttccgggacatttaaagcaacggtcaactcgagcttgtccacatggagagaatgccccatctccatacgccaaacagctgtcccggcctctttcatgaataggtctgactgatcctggggacaagagagccaaggacagagctggaggcaggagggcaggaatgtgtggtgacctggtagttctgaaacagcagaaagtccggtgtcccagcgcagtgacaaggccacagaggggttccagtgaatcccagtgtaaccgcccaatgggttcaccttgctggctgcctagacagagcctgtttatcaagacaggagaactgcaatggagaaagaggaattcacacagagccagctgggcgggagaccgggagttttattattactgaaaatcatgctctgccctgccccgcaccccaggaggttggtcccatgctccggatcaccccgactcccttcccctctggctccaagctggattcagcccacaggagacaccagcagaagatggaagcctgggaggagaggctgggatctgtctcctccactctctgcctgtctcagggcctccaggacggcagcttccactgggcagcctccccttgatcctaagggtggtaacagcttcctgctattgccagctgctgggtgcctcaacatcctttgttggtttccttaaacttgtccacatctctgtaaatcatcctttaccaaatagcccttcatctgaagcatcagtatgaatgccattcctgccaggactctgaccaatgcacatgcaatgcagtggaatgcagccgaaaggagtgttgacaccagattcaaatttagaaagcatttgaaagcatggtctaataatgtctccatggaagaggaagaacatgctgacaaaggaagtgaagaagctccccaggacctggtgcaccccatgtctcctgcagggtgaccgctggctggcaaagcctgtccctgtgttgttaagtcggattccccagagggagaagcagacgggccagcagcttgggtcaggtgctgcctgagcccctgttttatgaaaaacaaattgttgaaaggagagaaagtgaagaacagttgaagagaggaagagcggcagaaacagctgccactgagtagggattggttgtcacttgggtgccaggatctgctgatcaattagccaaacatccaacgtgagaaaaaggcccagcacacatctttttgcttaactgtcattaaatgctccatttaacccc

SEQ ID NO: 1416 - DNA, 3378 bp, Homo sapiens
taactatattgaagcgtcttgtgggaaccctcctatcagccacagggaagctggtcagagccagacctcgtgcctggggaatggggatcatgggtgctggcattgtgggtagggtgcctttgcctccctctcacaggcctgcctgtgttactgaccaatgtggagctgggtctagggtgcgaagaactgcaatggctgctgcaacgggagcagctgagtccaccccaggtgcagcctggcttctgtctgtatctcagcaccaccctctccctctgtgccatggaaaaagtgctaggttgtgaactgctaaaggggctgaatgtgttggatctgggcctgaacatggaaatactggaagaacagatgctgcatgaaatcttgtgcagagagtatcctgaactcgagacccgctggcaggacctaaagatcagagccctagatacctgcaaggctgtggaggctgctgaggagcggctgctgacgatgctgctgttccagaatccgaagcgtcagaagccagccaagtttctgcggaacatagtgagggcccaaggaaagctatgccagctgcgtgctcattgtgaagagttagaagggcagaaactacaggagatggtattgtgggcaccctatcgacctgtggtttggcatggaatggccatggtaaaggccctaagccaactgcagaacctgctgccacttttctgtatgagcccagagaactggctggcagtcactaagcaggctctggacagcatgaagccacgtgagattaatcacggggaggacctggccagccatctactgcaattgagagcacacctgacccgccagctgctgggcagcaccgtgactgcactgggccttacccaagtacccttggtgggtgcattgggcgctttggctctgctgcaagcaacagggaaagcatcagagctggaaagactggcactctggcctggactagcagcctctcccagcacagtccacagcaagccagtctcagatgtggctcgaccggcctggcttgggccaaaagcctggcatgaatgtgagatgttagagctgctgcccccatttgttggcctgtgtgcctccctggcaggccactccagtgcttggcaggcttacctgtcactgtcatccacagtgctgggtcctgcacctgggccagggcctgagccactcagcctcctccagaagctgatcctgtggcgcgttctgcgacctgagtgcctggcaggtgccctggcagacttcaccactagcctcctgggtcggcccctggatgaaaacacgtatgctcccaccatgccctttaaacatagtcaggctactcagcccatgctgatcttgttgccaccgcctggccacccctcagccactctgcatcctctgactgtcatccagaaactggctgccaagtatcagcaggggcagaagcaactgcaggtgatagccctgggctctgaagcctgggacccagtctcagttgtggtcagcactctatcccaggctatgtatgaggggcactggctggtgctggacaactgtcatctgatgccccattggccgaaagagctgctacagctcttgctggaactgttaggcagagccaaggtggttgcagacctggaatcagaacagcttttagaccaacctgaaagcaggaatgtaagcactgttcacagagattttcgtctttggcttattgtgcctgcagagtctagtgcttctttgccagctgtgctgactcagcactccatgcctgttttctggaaccagtccctggagctgggccatgttttgattgacagtgtggagctagcccagcaagtactctacatgcaaccccccacccaggcactacctctgctcctcctccatggcctcctgctacaccggcagctctatggaacaaggctgcaggcacacagggggcgctggagtcaagtgactctaacccaggttcttcagacccaagaccagctgtgggcaagtcttagcaatccccgtgctgccatgcaagagctggctgcttcagttttctacgggggtcctctgggggacactgaggacagggaggccctgattagcctcacacaagcctgcctgagccccagtagtgggagctgggtccagccacacacacctcagtctttgctggccacgctcatgcccctcccagagctaagggagctggatgcaatggcagagtgcaaggcccagatgcacctactgccctcaccacctgaaccccggctctgcggactgagtgagggcccccaagcctggctgttgcgacgccagagtcgcgctctcttgagtgcgctgcagcggagttcacccgtgtgggttcctgagtctcgaagaggcgcccagcttgcggaaaggcgactgcggcaacgcctagtgcaagtcaaccggaggctggagtcactgcaggatctgctgacccacgtgattcgccaagacgagtccgacgccccgtggtcagtgctggggccgaatgcacggcggcctctggagggcgtcttagagaccgaggctctagaactgagccagttggtgggcacgctacaacgcgaccttgattgcctgttgcagcagctgaagggcgcacccccgtgcccctcccgccgctgtgctgcggtggcccacgctctctggactggccgcctacccttgccttggcgacctcatgcgccggccggtccgcagccgccctggcactggctgcgacagttgtcgcgccgtgggcaactgttggttcgttacttgggcgtgggcgcggacgcgagcagtgatgtaccagagcgcgtcttccacctgtcagcctttcgccacccgcgccgcctgctgctggcattgcgtggggaagctgccctggaccagaatgtgcccagctcgaatttccctggtagccgaggctcggtctccagtcagctccagtataaacgtctggagatgaacagcaaccctctgcacttcagggtggagaatggtccaaatcccacggttccagagagagggctgctgctgatcgggctacaggtcctacatgcggagtgggacccaatagctggagccttgcaggacagtccttccagccaacccagccctctgcctcccgtcagcatcagcacacaggccccgggcaccagtgacctgccagccccagccgacctgactgtgtactcgtgtcctgtgtacatgggagggccccttggcaccgctaagctgcagagcaggaacatcgtgatgcatctgcctttacccaccaagctcacccccaacacctgtgtccaaaggagggtccatgtgtgcagcccacccctgtcttgagcccgtctaccaaaataaagttgtagtgattcc

SEQ ID NO: 1417 - DNA, 2899 bp, Homo sapiens
aggcggttgctacccacctgctagaggcgccgcggctgtgatccaggctggggcgagaccatgtcggacctgggctcggaggagttggaggaggagggagagaatgatattggggaatatgaggggggtcggaatgaggcaggcgaaaggcacggacgtgggagggcacggctacccaacggggacacctacgaaaggagctacgaattcggtaaaagacatggccaggggatctacaaatttaaaaaatggtgctcgatatatcggagaatatgttagaaataaaaagcacggtcaaggcacttttatatatccagatggatccagatatgaaggagagtgggcaaatgacctgcggcacggccatggcgtatactactacatcaataatgacacctacactggagagtggtttgctcatcaaaggttcggtttctatcttgggtcttaacgggatttgcttatgtaatgagaacatgatgtctgcagattgtttacacttactgaggaacagaatcataacaaaagcccagttaccaactctgccaggcaggtccaatctttctatggctttgaggcaaggatgcctttctgtgcaagtgtagactcaagtatctgacatctgcacctcagttggggcagagcacgtgagtctttcacccaagagtcccagggagtggagggcacagaagagccactgggggacctgagccacagctcccactagctctgcctcttccctggggaaagcagctgacacgcaggaggcttgcctctgtccagctggcctgtcctctgtgcctctggcaatgtcctgtgcttggggcacactgagcaaggggcaccttctgactggacacagatatagaagctacatcgcttgtgagcctgcaacagcctgggcctccctcaatgtcaatgtctgtgttttaaacctgggagatttttcactgtgctggaacgaaataccatgttccccttgtcttaaccaggcatgggcaaggcacctatttatacgcggagacgggcagtaagtatgttggcacctgggtgaacggacagcaggagggcacggccgagctcattcacctgaaccacaggtaccagggcaagttcttgaacaaaaatgtaagtccatgggaagtgacatttgccaatgaagtacaaaataaccccctctggcagcctgtgcaaatgtgtgaccagagaataccaaaaactcagagaaaactgagtccggcctattcaaatgtggagaacaggacagctgtgccattctctgagcctctggtacccacagagcacagaattgggggaagggagggattggcccgtttctctggatctcagtacaaattcccactgtctttcagcggggacctgttgcattgttatataacacgagagggcatctgaacctcttgtgtgtattccttctcatgggtaaatcagataccaaatatctatttcctgcaattgagcatagaggtgtttgggttttgtttccctggaaggggaggtgcgacatccctggggaggaagacccccagctccctcctcatgctacaggccagcctgcgtgctcctagttgtggtgggaattaaggctgccaaaggcctggccctgcgtctggaggcttgccagcttctagcacccatggtgggccgtttctgtttggaagactcggtggttcctcttgcccttattgtacagagaaaccttgaataattcagaagctaatactcaggccatcgtggtagctttgatcaggggttgagcagaaactttccctgaagagagaatttgcggagcaaattgatggtgttagaagttgacagagggaatgtttagctgatacaacgaagtctcttcagactctcttagaacccagttttcatttacgtataattcatgccctaaccacagattttacttttagccttcatcaaaacagcacattcccctcaaacccatacattgtttatataattcccagcaaactttctgtgggtctttttggaggagatgggaaggtggttgcagaggaagagaatttgatgaaaatgaatctggaagaatcaatcagcttgtccagcctaaaccagtctgaaaaatcgggcctgttggccctggaaagtatgtatttgatgttgggtgtgaacaacatggtgaatatcgtttaacagatatggaaagaggagaagaggaagaggaggaagaattagtaactgttgttccaaaatggaaagctacccaaatcactgaattggccctgtggacaccaactctccccaaaaagccgacctctacggatggacctggccaagacgctccaggagctgagagtgcaggagaacccggggaggaggcccaggctctgctggagggcttcgagggtgagatggacatgaggcctggagatgaagatgcagacgtcctccgggaagagagccgggagtatgaccaggaggagttccgctatgacatggatgagggaaacattaattctgaagaagaagaaactagacagtcagacctccaggactaagatgaagtgagccgagaggagatcgtatcataagaatgcttctgtcgttagctgggtgcagtgctgtgtgtatctagttccagctacttgagaggctgaggcaggaggattgcttgagtccagaaagtggcagttgcagtgagtggagatcgtgccactgctctccagcctgggtggcagaacgagaccctgtctcaaaaaataaacaaaaacaaaatgcttctgtcagttaacaatctttattagagggtttttagtctttctttctcagctgtatgttaagttggttgacaaatgcaaataaacgtctttattatcctttctttctgaaaaaaaaaaaaaaaaaaaag

SEQ ID NO: 1418 - DNA, 2126 bp, Homo sapiens
ataacagagaattctgtccccagggtgggggaagggccaggcagagcaggaagccttcggtaccatggacctgactggagaatatttcaccgcctggccctgggctccaggagagcccaccaccaccatggcccaggatggaggcagcactggcgccaggggcaagcaggtcacagatgccagggctcatttgacctctacttcatcttggacaagtctggcagcgtgaacaataactggattgacctttatatgtgggtggaggaaacagtggcgaggttccaaagcccaaatattcggatgtgcttcatcacctactccacagacggccagactgtcttgccactcacctcagacaagaatagaataaaaaacggtcttgaccaacttcagaaaattgtgcctgacggtcacacattcatgcaggcaggatttagaaaggcaattcaacagatcgaaagtttcaactccggaaacaaggttcccagcatgattattgctatgactgatggagaactggtggcacatgcatttcaggacactctcagagaagctcaaaaggctcggaaactgggggccaacgtttacaccctgggtgtggctgattataatctggaccagataacagcaattgcagacagccctggccacgtgtttgcagtggagaatggcttcaaggccctgagaagcaccattgatgccctcacgtcaaaggtctgtcttgatgtgacatcggtggaggcttcctctgagtgtgtaggagaaccctaccatgtggttattcatggaaatggctttcagaatctaaagaaacgggatgaagttatttgcagatttatcttcaatgaaagcactatcattgatgaaaagccaaccagtatcgacaataattccatgaattgccctgggccaaaactagaaaaacctggagaggagtactctattgaagtcagcttgaacaaaggcaaaacattcttcaagagcaatgtcagcatcaccagcaccacatgtccttctcttaagtagagctctggacatgaggaaggcctgagcagcctgccttcccacggatgccgcccaagattcctttattgcgaagaacacccagagaactgttcccgttgcttataccccatgtggccctggttctgagccaggacttggagctctctaaacctcacaagtgcccccagggagggcggctcattccctttgcacagggcattttccgcaactggctctattttgtgccactcctgctgcttgtgccactgctgctgtgttgtgtctggcggctgtgccgcaagcagactgtcaaggagccaccacctgcgcagaagccagaaaaggagccagagcaggaaaaaccaccatcaccaccaccaccgcctccgcctccaccacctccactcccgcctccgcccccagctcctgtaaacacctgccccactgtgattatttgttgctgtggatgccaaggaatgggcgggatgagaaggatagagggcaatctggataccttttgtgacctctctcacgcaagctgccaccaggtgccatggatgtgttgtcagagcagggaccaggggaggtacctcagcttagcccttgcacagtcccaatatgcacaggctccctgctgcccaaggatctgctttccacacagccaggagtgcctttccctaccacaggctccctgcagcccaaggatgtgcctgagacacagccgggagtgcctcgccctcaaacaggctcgctgcagcccaaacatctgcctgagacacagcccggagtacttttcccaagcacagactctgtgcaacccaaagagctgccttcaacccagccgggagtgcctccccctcacctgctcctccaggtgccgcctccccccagctaggtgcttgaggcctccctccaggatgctgccgctgctgcccccactgctcaggcacacggcagaaccccctttgtcactccccccctcagagcccaacttctaaggcaccaaacacccaagattaacaggcttttgttgctgaactggacatatacattgagtcttttcttgcggtcaaaggagttgaattcttgctgatcaactaaagttgattgtgtttgacacc

SEQ ID NO: 1419 - DNA, 1948 bp, Homo sapiens
aaagctcatctctccagattacagcaaggatgggaatctgaagcccaccacatccttctttccaagtcaaagaacgtaacactgagagggctctgagtgccagcatgtgcagagttggaacctcccactgacagccagaacgatgagccactcccgaagagctgctcctactcaggaccaatgccacactccaggattccccacctcccgtgaaaccagtgggagcatatggcaggccaggatctgtggatctttacaggctctggacacatggcgaacacacatccccagaaagagcccagctcccactcaggcatcacagatctgtctgctgttgcctgaaagcccctggagaaatcccacaccccggggatttcttaaacctttgattaactgggatgctatcctgtacttcaaagaaaagaggaatatccaagtaacaacacaagctcatccccagaaccaggccagctgcagctctcaggaggtagccacacctgggctagtgccacaggcagctgcaccaaaggtgtatgagcggtcacatgataacctgaacgctgaggcccaaggactggcaggtgctcaggtgtcgaaaccacagaatcccattaccaggctctgttctctgaaggaacagtcaatcttgaagatcttcactaagcagagcatctgaggtttaccggcttgaagacccagcaaactaagagttcagcaaaccagaatagcctctctggagggcacccgtgcctctgccggtgctggaccctgcgggtccctggtctatgagcttccccagaaaccctccaatctcatccacgcagctgccagaatgaatgttcaaagataagaacctgagcacagtggctgggggtttcgcacacccctgggactcgaccccaagcttctccttctcagcactgcagcccaagccgccctgcccttcctcccaatgccactacttgtcactgcaccttggattccaggccggcccttctgctgccctctctgaatgcccggcctcaatctagcctcctcctcatcccgcgagacatggctaaaacatcacctcaccctggaggcctcccctgacccctataaggggacaggtccctacagcagcccaggcttcctcttgataatgtgaatgttaattactttaattaagactttaaattactcctctaaaatctgtcttccgtgctacaaccacaaactccaagaggacagggatcaggctttccttgttctcctgccccactcccacagcacagggccaggagatgctctgtcaacactggctgcgttgaaccgaagtcatctccccaccgcagcgctctgcaccacacccagcaccagggcaggtgctccatgaagggctgcgtgaatgactcaacttcagccccataaggaatctggacagcacaccacgcaagttaaacgcttctttacaacataatgaaaggcggacttggactgtactaatgaacattccccaaacctaggaagctagatctaaaaaggactacaaatgcaataatcacatgtgaaatccaggaccgaacttcttttttttttttttttgagatggagtctcattctgtcacccaggctggagtgcagtggcgcgatctcggctcactgcaacctccgcctcccggtctcaagcgattctcctgcctcagcctcccgagtagctggaactacaggtgcatgccagcacgcccagctaattttttgtatttttagtagagacggggtttcaccatgttagccaggatggtctcaaactcctgacctcgtgattcatctgcatcaacctccttaagtgctcggattacaagcgtgagccacagcgcctggcccaaacatttttatatgtccacttaatagttgactgacagaaataaatggtatgttttacacagatgttcaaaagtgacaccgt

SEQ ID NO: 1420 - DNA, 1809 bp, Homo sapiens
gaccgttaatagtccccgccgcctggaagttctgacagcgccctgaagcccatttgtcatctaaatggtccgtccccttcttaaacatcattttggcccaaggtccattcatggggcctgccgggtgttcctgggaagatgggcagaaaatcccaaggccaccatttagtgccaataaacagaaggcctggtttcttcaaaagaaacacaagaaattgtttcctggttttgccacagagattgggtcacagagtgccacctaaatggtattaccatatttgtgttgtcgcctcttggtttgaaatttattcctggtatgacttgtgtctccccttgttccatctctgacacccaagcccatgggatgacaacccaggctgagatgtcccatgtgtcacaaaggagtccttcagtatttccaggaatagttggaaccagcactccatcccctacctggacctggcaccctctctactcttgtcagttctacactaatcacaggaagaaggtggaattagtccaagctgggttttcagaaataacttgtagacatgcaacagatgtttataaccctcagaagcggaaggaaacttggaaaccctctctttcggtgactttttttctaatgattgtctctgccatgaaattctaacttcaaatgaaatctttggcaggaacccagggctgttctgtcaaggttcagctgcaggaccagagccccttccacctaacccccactcctatcctgatgcttcctgaggcacatctgctgtggtttctcaccagagaacagtctgcaaaatcactgcaccttgtccaactccattttccaactgagaagacttggcccagagaagtgcacagacttgagggaagtaacacagcaatcggacagacagacatccccagatatacctgctacggtcctgggagaaaatagagacccatccccaaataccatcatcctcatcattctctgtagcccaatcaaatgatgctccaggcctgagattttatccaatgaacactctgtacatctttaaaagagatatgtacttgtcttattcctcctttcctttctttaaaaaaaacacaggccccagatccagtcattctaaataggaaggaaaaacataacccactgaggcaatggatgctgtttctctccctgctctgtgactttagtttgcctttaaagcccattttcaccatttattgattttagttttctacttgtctatgaatgacaacttgaattaagacaacgcaggctgaaaagccgctaggcagtgctaaatggacaagctacacttcgtggcaggatgtctcatgaccgtgccaccttctgcctagccccattctctggaggagctgtgggcagaccgaccccagcctggccgcctggcatggggactggttgcgtcagatcggagctctgagataagggtgggccagggcatgatcatcaccactgccagcctcgaagcctctttgctgacctggaggtgatctgtgtatcaaagggggctgtgtattcaacagcacttccagaagaggccaaagatctgtctctacttcagcctccactgggcagaaaactaagcctatttgctctaggcccttcagacttgcacttggagaaagaaaactcactaagtcagcccttatgtaactccactctcctctcttccaaacctccttgctttggacaaatatttgacagaaaatgcccttttgcaacgccttaaaagttacaaaaatggtgcaccctatcctttaatctgtactgtaaataaaaaatattaacac

SEQ ID NO: 1421 - DNA, 1631 bp, Homo sapiens
agaatgggaccttccgtggacataggactgttgcagacacagttcgcttggtgaaggaggcaccgtgctgcagtaggtccttgatgcggccatgtccctgcgacaggaaggacaaactccagcacacagagtcctcgaagcagcagtgtccctgtgatggggaggacagactccggcacacagagtcctcgaagcagcagtgtccctgtgatggggaggacagactccggcacacagagtcctcgaagcagcagtgtccctgtgatggggaggacagactccggcacacagagtcctcgaagcagcagtgtccctgtgatggggaggacagactccggcacacagagtcctcgaagcagcagtgtccctgtgatggggaggacagactccggcacacagagtcctcgaagcatccgtgtccctgcgacggagaggacagactccggcatgcagagggaagccgtctgcgtggctcggaggcaggagggaagcgctgtgtctgtgggccgagggctgctggcaacgcagaggctgggagtcaggaagggtcggtgtccccttcaaggccctgcagacacctccaagcaaggtctccaaacccagcctgtgagactgcaggcatccactgtttcaagcccatccgtctggagtcctttgttctggcagccccaaaagcctcacacagctcggctttgagtacagggagcgtgtctgcaggtaaggtggggaggccacacagaggcacagcggctgggccctgcaagactcagggagggcgggctagcatgtccgagggcaggaggcagatgccacagggcatcaccagctgcatgttgcacctcgacggcaaaacacagaagccactgcccaccgcagggagcgcagactgaagggacccgggctccttggccgagctccagccggaggtgcttccggtgcaatccaggcctctcatcctcccacggattccccacagagggcttcggttccattattgtatagacttcacgtatgtaaaaggtacaggaattcagcatttggaccccgtggggcagtgtcaccatggagcacgcacagggtgcctccctgagctggcacatccctggaggcatgcgtgcctctgccgacatcccaaagcgcccgtgctggggtcccacatggtgtccgctgtgccgtggggttcctcttccaacccccacaagaaagagaaggtcaccctgccccccacctctccacagctccctggactgggccacatttctttatcctcttcttggtttttaattaactttgggccagcccatctgtgcctgttctggactccagttttgacagctactgactgaattgcctggtcagttccgtgaaaaactagaaatagaaatgcacccggccagctgctgcctgagctgaccagccccggccgtcagtggccttccctggttggacggaccgtgaatgctgccagttctgtttcattttaactatgtgtatttgtataaatataagaaactgtctgctctctacccacagagtaattgtctagctctatcatctaattatctcaacacgtttagtgagcgagatattaaggcccagattagatattaaaaggcatcgttaaagaacag

SEQ ID NO: 1422 - DNA, 2172 bp, Homo sapiens
gggggcccagcggcccgcgccccgtggcttgacctccccgactgctgggcccgtgacgtcaccccgctgtgacgcgcacgctgtaggaaaactataaaaatgaatgccatttcccatccagtactgaagtgttaaagttagaagacatttgctaagtcaaatcacttcaggtatgttgaagaaagtacgcacatcttatcttctgaacattttgatggaattaaccacaaacttcatgcaagaacagtaaaaggaaagatactattcaagtccagtacatcataatgcagaattctgtatcagtaccaccaaaagatgaaggtgaatcaaacatcccttctggaacaatacagagtaggaaaggtttgcagaataagagtcagtttaggaccattgcaccaaaaattgtgcccaaagtcctaacgtccagaatgctgccatgtcattcaccatcacgctctgatcaggacctaaggccgactgtgataagataccctccaccacagaaggctttaatgcagccaccaaggtggcaagcaggctacctgttccacaagtgtcacagcagagtgcctgtgaaagtgccttttgtccacccaccaaacttgatcttaaccacaaaacaaaactgaacagtggagcagcaaagagaaaaggaagaaaacggaaggtaccagatgaaattttggcatttcagggaaaaaggaggaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagtataactgtgaggacccttccatactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgattttcgtacatggttttattttcttaacgaaataaaatataagctctcgaagc

SEQ ID NO: 1423 - DNA, 1819 bp, Homo sapiens
aacggccccatccggcgccggcggcgggtgcccggcggtctttgctgccgcccgggggcgcagaggccgggccttttctttcagcacaaacgtcagtttgtaaaagggaggtgctggagtctgaggagttttcaggcttccgtctcgaaggaagtctggcaggctcggaattgtcatcttcctcaggcaaatagtttttcaccttagagccagcaaggccaaaccgcccagtcacccgacttcccacagtctcagcagggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggttgtttccactttggaagaaacctatggacattgcgatcagaatggagaagaaccatttgtaaagcatgaacatgaagaattatctttatctgttggggatgatatgaattcattcttgacatattgttcgcaatttgcagctcagctagaagaagcacttaaagaagaacaaaatattttggaatctctttttaagtggtttcagtggcaggtcaatcagatggaagaaataagtaaagatcaaactcttttacaagcagagcctccaaaacctgacaaaacagtcattttaaatattgcagaaatagtaaggcttgtacaaagatttgaagaactgaagaatcgccttaaacagaggtctaaatcctccgtgaaagtcatgttgtctaaaactatggataaagaaaatcgaccagaagcagtgaaaagttgtgaagctctggcacagaaaattgaagaattcttagaagcccactcaactgatgaatttaaagatgtttctgcaacagaaccacagctgtaaatgatcaagttttgttagatgctgaatacaaacagatgcagtgtgattttcagttgttatcagaagagaagttggtgctggaaaatgaactacaaaagttgaaggacaaagagaaaactaagcctacaaataatcgaacaaagaaagctgtgaaaacagtgaagaaaaaagacaaaggaaaatctgaggattcagaaaagaagatgtctccagaaaaagagtttaaaataaaagaagatttggatcaagtacagaaagtagcacgtctggaaattgagaacaaagtccttcaggagcaattgaaacaggctttacaggaagctgaaaaagctaagcatcaacttaactatttcctaaatcaagagaagttacttaaaagtgaggggaaaactgagacaacaatgcaagtgggtaatagtcaaacaaaagttaaaggtgaagattcaaaaaatataccattggagaaagaaacaagaaaatcactggtttcagattcaggtggacaaaggacaagtgataaaatccaagaatatccacagatcactgcccaaagcggaagactgattgaaaagagatgctaatagagtttctgaaatactttggaaaagtctcccaaaccttcagagagtggatgggagcgaagtaaggagaccccacctgagcagatacatggtattgcttacaataaagtacatttttgctcttt

SEQ ID NO: 1424 - DNA, 2655 bp, Homo sapiens
aaaaccgacaaaagagagatgatggccaacgacgccaagcccgacgtgaagaccgtgcaggtgctgcgggacacagccaaccgcctgcggatccattccatcagggccacgtgtgcctctggttctggccagctcacgtcgtgctgcagcgcagcggaggtcgtgtctgtcctcttcctccacacgatgaagtataaacagacagacccagaacacccggacaacgaccggttcatcctctccaggggacatgctgctcctatcctctatgctgcttgggtggaggtgggtgacatcagtgaatctgacttgctgaacctgaggaaacttcacagcgacttggagagacaccctaccccccgattgccgtttgttgacgtggcaacagggtccctaggtcagggattaggtactgcatgtggaatggcttatactggcaagtaccttgacaaggccagctaccgggtgttctgccttatgggagatggcgaatcctcagaaggctctgtgtgggaggcttttgcttttgcctcccactacaacttggacaatctcgtggcggtcttcgacgtgaaccgcttgggacaaagtggccctgcaccccttgagcatggcgcagacatctaccagaattgctgtgaagcctttggatggaatacttacttagtggatggccatgatgtggaggccttgtgccaagcattttggcaagcaagtcaagtgaagaacaagcctactgctatagttgccaagaccttcaaaggtcggggtattccaaatattgaggatgcagaaaattggcatggaaagccagtgccaaaagaaagagcagatgcaattgtcaaattaattgagagtcagatacagaccaatgagaatctcataccaaaatcgcctgtggaagactcacctcaaataagcatcacagatataaaaatgacctccccacctgcttacaaagttggtgacaagatagctactcagaaaacatatggtttggctctggctaaactgggccgtgcaaatgaaagagttattgttctgagtggtgacacgatgaactccaccttttctgagatattcaggaaagaacaccctgagcgtttcatagagtgtattattgctgaacaaaacatggtaagtgtggcactaggctgtgctacacgtggtcgaaccattgcttttgctggtgcttttgctgccttttttactagagcattcgatcagctccgaattggagccatttctcaagccaatatcaaccttattggttcccactgtggggtatccactggagaagatggagtctcccagatggccctggaggatctagccatgttccgaagcattcccaattgtactgttttctatccaagtgatgccatctcgacagagcatgctatttatctagccgccaataccaagggaatgtgcttcattcgaaccagccaaccagaaactgcagttatttataccccacaagaaaattttgaaattggccaggccaaggtggtccgccacggtgtcaatgataaagtcacagtaattggagctggagttactctccatgaagccttagaagctgctgaccatctttctcaacaaggtatttctgtccgtgtcatcgacccatttaccattaaacccctggatgccgccaccatcatctccagtgcaaaagccacaggcggccgagttatcacagtggaggatcactacagggaaggtggcattggagaagctgtttgtgcagctgtctccagggagcctgatatccttgttcatcaactggcagtgtcaggagtgcctcaacgtgggaaaactagtgaattgctggatatgtttggaatcagtaccagacacattatagcagccgtaacacttactttaatgaagtaaactaggcttatttctaaaaagtcaagtctattggctttggcccaaaagcactggtatctttgtattaaattcatgtttattgtcacaaaaccattatttatacctatacagttgtactgtttcttttaaagcaaagccatttaacatctttcttcattcctaatttggaaattaaagtttacctttctgttaatctatgtataaatgttactctgagttattaatgtggattttaaaattgtaagcaatagaataggaaataaaacaactacctaatacaaatatttctgataagactacaaatatctgactgagctggggattaaagtagaggtaactgtatcttaaatgagtatgatttccttgtaagttaaaaaaattgaaatttaattgtagacttcaatagtccaagttttgaaggatgtttgagcttttgtataatgccatttatacctgcagttttacagataatgtttgactgcagttgccttggaaattcctccaaagtttgccttcatctctcctctacagtttggaggtgatggtgcagcagtggaacatctcttgatgcaccacactacttgtgttctgtgaagtgatgaaagtataactggttctagtttgcacactacacacatagttttgtgaagcttcagaaatgttttttcttttccttgtggccaaaccagtttgttaatctgattatattcatctgctaatgatactaaagttaatgtaataaagcatttaaaaatc

SEQ ID NO: 1425 - DNA, 2156 bp, Homo sapiens
gcgctgctcgcaccccgggacccgcccgggctgccggctgatgtggaccgtccgacccgcgtgtctgataatcctttgacgggttttggtcggcggagaatggtctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaatgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatc

SEQ ID NO: 1426 - DNA, 2339 bp, Homo sapiens
ctcattttctcttgcagccgccatgattctgaggccttcccagctatgtggaactatgactgtgatgatcctcttgtgtctgccttgcctcaggcatccttcagcagttcttccgagctctccagcagtcatggtcctggatttgcaaggctgaatagaagagatggagctggtggctggtctccacttgtgtctaacaaataccagtggttgcagattgaccttggagagagaatggaggtcaccgctgtggccactcaagggggatatggtagctccaactgggtgaccagctacctcctgatgttcagtgatagtggctggaactggaaacaatatcgccaagaggacagcatctggggtttttcaggaaatgcaaatgcagacagtgttgtgtactatagactccagccttctatcaaagccagatttctgcgcttcatccctttggaatggaaccccaagggcagaattggaatgcgaatcgaagtgttcggatgtgcatacagatcagaagtggttgatcttgatggaaaaagttcccttctctacagatttgatcaaaaatccctgagcccaataaaagacattatttctttgaaattcaaaaccatgcagagtgatgggattctactccacagggaagggccaaatggagatcacatcacactgcaattaagaagagcaagactctttttacttattaattcaggtgaagctaaactgccttccacttccaccctggtcaatctcaccctgggcagcctgctagatgatcagcattggcattcagtgctcatccagcgtttgggcaaacaagtcaacttcacagtggacgaacacaggcatcatttccatgcacggggagaattcaatctcatgaatcttgattatgagatcagctttggagggattccagcacctggaaaatcagtgtcattcccacatagaaattttcatggatgtttagaaaatctctattataatggagtggatatcattgatttggccaagcagcaaaaaccacagatcattgctatgggaaatgtgtcattttcttgttcacaaccacaatctatgcccgtgacttttctgagctccaggagttatttagcactgccagacttctctggagaggaggaggtttctgccacttttcaatttcgaacttggaataaggcagggcttctgctgttcagtgaacttcagctgatttcagggggtatcctcctctttctgagtgatggaaaacttaagtcgaatctctaccagccaggaaaattacccagtgacatcacagcaggtgtcgaattaaatgatgggcagtggcattctgtctctttatctgctaaaaagaatcacttgagtgtggcggtggacggccagatggcttctgctgctcctctgctggggcctgagcagatttattcgggtggcacctattattttggaggttgtcctgacaaaagctttggatccaaatgtaaaagtccacttggtggatttcagggatgtatgaggctcatttctatcagcggcaaagtggtagatctgatttcagttcagcaggggtcccttgggaacttcagtgaccttcagatagactcatgtggcatctcagacaggtgtttgcccaactattgtgaacacggtggggagtgttcccagtcctggagcacctttcattgtaactgtaccaacactggttacagaggagctacttgccataactctatctatgagcagtcatgtgaagcctataagcacagaggaaatacttcagggttttactatatagattcagatggaagtggtcccctggaaccatttcttctatattgcaatatgaccgaaactgcatggaccatcatacagcacaacggctctgacttaacaagagtcagaaatactaatccagagaacccatatgctgggtttttcgagtatgtggccagcatggagcaacttcaggccactattaaccgtgcagagcactgtgaacaggagtttacttattactgcaagaagtcacggctggtcaataagcaagatggaacccctctgagttggtgggtaggaagaaccaatgaaacgcaaacctactggggaggttcttcgcctgatcttcaaaaatgtacttgtggattagagggaaactgcattgattctcagtattactgcaattgtgatgctgaccggaatgaatggtgatttccatacgatttctttatgcaagaaaaagttcatttaaaaaaattaatcactcaaagtatgtatagctagccagatactgaacaagttagtgcaatgaagtaattaaataaaggtttgttttaatg

SEQ ID NO: 1427 - DNA, 2028 bp, Homo sapiens
tttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcacctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaaagaaaactc

SEQ ID NO: 1428 - DNA, 2821 bp, Homo sapiens
tagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccagcatggccgcctggagggcgcccgccccacgcagaggagatgaggccgtaacgcacgttctgtgttctcttgaagcaaggtgcagagctagaaatgaaagacatccagggctggacagccctcttccactgtaccagcgccgggcaccagcacatggtcaggttcctcttggacagtggagccaatgccaacgtgagggagccgatatgtggatttactcccttgatggaagcagctgctgctggccatgagataatcgtgcagtattttctgaatcacggagtcaaggtggacgcgagagaccacagtggagccacagcccggatgctggccaagcagtacggacacatgaagatcgtggccttgatggacacttactcgccctctctgcccaagagcctctatcggagcccagaaaagtacgaagatctgagctcttctgacgagtcctgccctgctcctcagagacagaggccttgccggaagaagggtgtcagcatccacgagggaccgcgagccctggccaggatcacaggcattggcctgggcggcagagccccacggcctcgctatgagcaggctcctccccgtggctatgtcaccttcaacagcagtggcgagaaccccctggaagaagagggcctctgctgccgggatgtcacctcccccatcaatgagcgggatgtggagagcagcagcagcagcagcagtcggggtacgtgcacccccacccatccggcccgtggctcaggcaggtcctggagctcctgtgtgcccatccccacttatcccctgggcctggcgctggacacagccatccagcagaggacaggaaaggggtaggtgtggacggccctggttcttgtgaggaatgggagaagcttctggtccagcatccccgtgcggcttaagggagccgttccacagcaacaggtttagctccttgcttgggagcccctgaggctttcagggcaggccccagtaggaatgtctgttataactgcacctccgtgcagcagctgtttccatagtgcccaccgtgtgccaagcactgctccgggtgcttgggatttatcagtgaacaaaaaagacagaagccctgcccgtctgtatagaggggagggtttaggacaggcaggaagtttgaaatataaggaagcaaccgctgcaggccccaaggagtgccctggtggaggcggctcagcccggggcacgcccatgcgcagcacctcggtgagggctgcaggcggacgccctgtcttcccgccctcagaggaacatgctttctgtgccaacctggggcccgtccagagcagcagcagcagcgagggcctggccagagcccaggggctcagcagcgaagcttctgtggagagcaacgaggactcggatcatgcctgtaaaagctcagctcgcaaacaagctaaaagttacatgaagaccaagaatcctgacagccagtggcctccccgcgctgcaactgacagggaaggctttctcgctgagtccagcccccagactcagagggccccctactcaggaccccaggaccttgccgcactgctggagcagatcgggtgtctgaagtacctgcaggtgtttgaggagcaggacgtggacctccgcatctttctgaccctcactgagagcgacctgaaggaaattggcatcacgctgtttgggcccaagaggaagatgacgtccgccattgcccgctggcacagcagtgcccgcccacccggggatgccctggagctggcctacgccgaccggctggaggctgagatgcaggagctcgccatccagctgcacaagcgctgcgaggaggtagaggccacgcggggccaggtgtgtcaggagcaggagctgcgcgccgtggtggagagctgcctgctggagcaggaccgcgcccgcgaggacctccaggcccggctgcgggagacgtgggccctggcccgggatgctgccctcgtcctggaccagctgcgagcctgtcaagctgagctgtcatctcgagtgaggcaggaccagccccctggtgcagccactctgggcctagccgtccccccagctgactccaagggctggcaagcgtccctgcaggccatgagcctccccgagctctcgggagccctggaggaccgtgtccgtgagatggggcaagcactgtgcttagtgacccagagcctggagaagctgcaggtgctgaacgggaagaagtggcgggagacctagcctacgggccgaatctgacgttgggtgattggtccaccctgaagctgtgtgccagggagtgaggaggacagtgagcaggtagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagct

SEQ ID NO: 1429 - DNA, 2613 bp, Homo sapiens
gctagcggtgcgcttctggcctgttttgagtccgcgctcaaaggtgccaaagtgcaaggacccacagttgggcggagcttgggttgggagtgagacagcatagcagtccaggctggtcctttgagcgcagctcaaagaaggggacggggagggcgtcactatacaattgtggccgggtgggacctgggctgtttgctcttggaggctgtacagctgcaagctttgccgctcacgaactggagctggagaaagagccccccaaggatgggaggatgacagaagtgtctgcagatggcactgcctgggcaccaggagaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatggtcagctgaagagtgtccctcagagaactgacttcccagaaacacgtaatgtggaaaagcaccaggacatccccacagtgaaaaatatccaaggaaaggttccaagaatcccctgtgcaaggaaacctttcatatgtgaggagtgtgggaaatccttcagctacttttcttactatgctagacaccagagaatccacactggggagaaaccttttgagtgtagtgagtgtggaaaagcctttaatggtaattcttcgttaattcggcaccagaggattcacactggagagagaccctatcactgtgaggagtgtgggcgagcctttaatgataatgcaaatctgatcaggcatcagagaatccacagtggggacagaccctattactgtacagagtgtgggaatagtttcaccagtagttccgagtttgttatacatcagagaatccacactggggagaaaccctatgagtgtaatgagtgtggcaaagcttttgttggtaattcacccctacttcggcatcagaaaatccacactggagagaaaccctatgagtgtaatgagtgtggcaaaagctttggaaggacttcccatctaagccaacatcagcgtattcacacaggggaaaagccttattcttgtaaagtatgtggacaagccttcaattttcatacaaaactaactcggcaccagagaattcacagtgaggagaaaccctttgactgtgtagattgtggaaaagccttcagtgctcaggaacaattaaaaaggcatctgagaattcatactcaggagtcttcctatgtatgtgatgagtgtggaaaagccttgactagcaaaagaaatcttcatcagcatcaaagaatccatactggagagaaaccctatgagtgtagcaagtatgagaaggcctttgggacttcttcccagctaggtcaccttgagcatgtctactctggagagaagcctgtgctggacatttgtcgttttggcctcccagaattttttacccccttttactggtaatagtacactccagtgaaatgtactgagtggattccgtcttctactcaggaatggaatgtgtgacacaggcctgactcagcctctgatccatccctcaagccacagttaatgattcagatgtcagtagatgaccaaagatggttcaattagagtcccaggattgcaagagctaataggaacaaatactctccccccgcccacccccattggttttaatgctgagaagaagaactagactcttacagaggtgagaatgaagtccacacagcaaaaatgcatctgagaattggagagcagtaaaagactgaagataatgtttgaacagccacatacaccatgcctgaagctaaaaatatatacgggtttttgaattgcagcagccaataaattccatttttgtttggttggttttggctttggcacacctgagttaggttttcttgccttggaacagaattttgacttaaacagtgttgtcattgtagcagttgtttgaagttttcagggataacatacctgatggagaaatgttttgtgtgtatgatatatgggaaagtctttagttatagtcatggcagctcctcaaccccatgattgtgatgagattgggaagcccactgtaacactggagagcccaggttatatcagacaccactagtagatagaaattctaacaacttgagctctgtaacaaaaatctcattgtactacaaaattatgtctgcaccagtgaatccattctcaagaaaagtcttaactaggaaactaaaagctttcactcttagaaacatt

SEQ ID NO: 1430 - DNA, 1746 bp, Homo sapiens
gctacgtgagacgtgtacgcttctgtttcaccttccgctgtgattctaagtttcctgaagccggctaccctgcttcctgttaagcctgtggaactctagtggacatctgaaaccctaaaacatctcatctgtgcaaaaaagaggaatgagccaggtcgggagagtgagaagctcgcaccacttcgaaagcgtctgcctggatgctgaagttcgggttgttcttgtagctctggatcacgcaggacttcacaccttgtcctccgcactcaatgagagcctgaggccgatccacagagaggagctgcaccttcttcatttcccgaactccccagaagagaacctgaggaaaagaccagcagagccatcaccacagatccacggaggagccccacacctgccctggctctgtgtggaaaagtcagacctgctccctgagaaccacgctgtgttcctccaggaaagaactgcacagctttttgagggctcattctttttctctaggtctcccgcccattccatatcacctctcctacaattcaggtggggccactgcccttgagtgccaaagaacaactcagctcctccgctgacccgtacctccactcggtatttgctcagcaccggccgaatgttggcaggaaccgggtagatctgggtgatgtctggtggctcaacgggtgggaggccttgcagcccagaagggggaacctaccgcacaagacatattctcgttggcaacagcagatgtggttaagctaattacaagaaagctcagaaaaaggagagcagacactgcaaatgcgcaataggcttaaggtaatgaagctgcaggatacaccagcccagatcaagaagctggtaaataatgaggatggcaatgcccaatactgcctggcagtgatgagagtcaataatgtcagctgaatttctccataaagggcttgacttagggttgggccaggaaaagccattactgaatggagatctggaagggaaatggaaagcaatgggacagcaaagggaaacacagccagctcagcaggaagcaagatgggaacttcatggtctccaaggtctctgctccccttctgtgatgctcacttcttgactccctcctgaccttgacccaaagacaggggctgtcaggagtactgcgaggaggtggggaagctttaggcaggcttcctggaactactgttttacttaatatatttgtgcttctgcaacctcatgaggaggtagagatattaaataaagaaacaaaccctttcctttcattttagactacctaatttaagaaaagaatatttgtgtaagttaaaaaaatcctccagtaagcttttgactctatccaagggttcagcacacaaacgtctttggagaacaagaggtttggttcacatcataaaagaaaagggatagagattaaagtgttgtgaaaggcgtcgaagcaacaagcaagagagaaagaagcacagaaaggctgagaaaatacccatccatttcttttcagccaggggagatcagtaaaaacctcctgtctccaaaaagcatggacatttttattaaacagcaataggacctggaattagctggaggctgggtacagttgcaggttgctttatacaagtatcacattcctgaagaagtgtgtagactgacgttctgtaaaccagatccaattttaattgccatttaaatggaagtcagtgaaaaactcttttagtaaagcaaatgatcatcacc

SEQ ID NO: 1431 - DNA, 1531 bp, Homo sapiens
gtttctcctgcttggcctcctccaggagggctggcttctctgcagagctctgcttcctgcagcctctccccgacctcagagcctctgcagaggaaaggccccctggggccctgccccacagcatcatgatggggaaactccccctgggggtcgtctccccttatgtgaagatgagttcggggggctacacggaccccctgaaattctacgccaccagctactgcacagcctacggtcgggaggatttcaagccccgtgtgggcagtcacgtaggcaccggctacaaatcaaatttccagcccgtggtctcatgccaagccagtctggaggccttagacaacccggccaggggggaacaagcccaggaccatttccagtctgtggccagccagagctaccgccccctggaggtgcctgacggcaagcatcccctgccctggagcatgcgccagaccagctcaggctatgggcgggagaagcccagtgcgggtccccccaccaaggaggtccggaaggtccatttcgacacccaggagcacgggcctcaggccatcacggggctggagcccagggaagtgcctctgctccgccagcagcagggccaggacccgctggagcgggagaacttccgacatggcccacgcttcatgacgtcggagtacaattccaagtatctcagggaccctctagaccagccagatttcttgcagaagaaatcgatcggcgcaaaggaggggagtggcttcaccaaacagtcccaccagagccccattgtcttccaaccgccctcacaggccctccctggggaccctgccctcctcccaggccagagtgtcaccaagtcagacttcctccccaagactcacctacatggagatgagttcctacctgtgttggccagaggctccaagcgggaaacagccttcagccgagggaatgaaaggattctgaaccccagagtgccccctccctgcccagaacccagcagcgtgagtcaccagcagtttcagccacttcatcggatgcaacagacaaacgttgccctgcttggccgggagactgtggggaaaaaggagcccacagggttcagccttaacaaccccatgtatgtccggagcccctgtgatcctgacagggatcagcgatacctgaccacctacaaccaagggtactttgagaacatccccaagggtctagaccaggaaggctggactcgaggtggcatccagccccagatgccaggaggctacgccctcagccagccggtcagctgcatggaggccacccccaaccccatggagagcctgcggcacctgcatccccacgtgggaagaaccctgacctcagctgaccccttctaccagaacacacctcacagcagccgctgcgtggcacacagctgagccctgagcccttggtttgtcaatcctaggggacaggagccaggctactgtctgtacccccactccatcccccaggggaacacccctgcccagctactttcctaatgaaataaagagcattgaagcag

SEQ ID NO: 1432 - DNA, 1910 bp, Homo sapiens
tttctaccaaggtcacattgctaattcattggaagagaccctaaagtttgcctcgtatgtgacatttggttcctcttggtctctgggcctcagtctccccatctgtagcttggggggtatacctaaggctcctccaccaggctcagacgggctggcttcccgggggccacagggatggctgctctcatctgcctgggggactgtgctgggctggagaggggcaggggagggcctggtggagaaggacatctttgctgacccaggctcttctggcaagcctggaccacagtggcagtggggcccgctgtgccaggggtcccgtttcctcctctccctgagggggcggggctgagctctcagatgctcctctgtccctgcaccctcccagctgaagaagagagccctggaccagctgcggctggtgaggcccaagcccgtgggggcgcctgcaggggactccccggatcagctgctgctggagccctgtgcagagccggagcggagcctcagaccctacagtttggtgcggccgctactggtgtctgccctgcggcccgtggtgctgttgcctgagtgcctggcgccccggctcatccgtaacctgctagacctgcccagctcccggctggacttccaagtgtgcccagcggaaagcctctctggggaggaactgtgcccatcctcagcgcctggagcccccaaggctcagcctgccacccctgggctaggcagcaggatccgggccatccaggagtctgttgggaagaagcactgcctgctggaactgggtgctcggggtgtgcgggagctggtgcagaacgagatctaccccatcgtcatccacgtggaggtgactgagaagaatgtccgggaagtcaggggtctgctgggccggccgggctggcgggactcagagctgctgcggcagtgccgtggctcagagcaggtgctctgggggctgccctgctcctgggtgcaggtgcccgcccatgagtggggacacgcagaggagctggccaaggtggtgcgcggccgcatcctgcaggagcaggcccgcctcgtgtgggtggagtgcggcagcagcagaggctgccccagcagcagtgaggcctgaggctcatctgatacctgcaccttctccccaagccagcgtggaccctggtgtctatggtgaagctgggccctcccaccctgagccttcctagacccttggactctcagatgcagggcccttggctctggcctctcacccccaaggctgtctctggccctgccgagcctatgggagtcccgggacagagtgcccactcccctctacttgctgctctgggcctccccacctttcctggggtctccacattcccactagtgggtcttatgtgtgtctgtgtcttctccttaaacactcgccctggagtctgttctcacacctgtgcgcaggtttgcacactcaagttctcatgggcaggctcaggtctgtcccgctgccctgggcacgaggtctcctgaggacctgggcctgttctgctcctaggagacctgagcccgttaccgcgtgactcccaccatccagctcgcgctcctcgtggattcagccatgcatggactggggtgttccctggcccatggtcacctgtgcccctcgtgtctcctcacatgggtgtctgtggttctctcctgtgtaaatgtcacgccccacccctgtttcatgtgggcactaacacgtgtgcgttcctggcgggcacactcaggaccgtgcctcacagggcccactccctgcctatgcctccctcttggggggccgaggagggcggctgctctgtcatgagaatgtacggcccgtggatgattaacgggcctttttcacttagaagctgcacattatggagcattaaacacttttgtcatag

SEQ ID NO: 1433 - DNA, 1809 bp, Homo sapiens
ctctatttgacttcaactacaagagagatgccaagctgagaccagttaagccacagaactcttttaccttcgttaactcaaacctgcacccatctgaagtgaaaccagcaaccacttaacagcaaacagtagcagcagcatgcaccaaaagagaatggaaagtgaaaagaacacaacagatcattttaaaagtagtgtgtcaattgcctggttctccactgacagctaaaattaaacaaaaaagtgaattccgttctacagtgtgaccatcttatgggaacactagaggatatccatagacagcagagaaaaaatagcaaaatagatattttgactcacagaaaatgaatgtttgcaaagattcaccaagaaataaagtcaaccaaaaaagcaaagtcatggaaaagaaactccctcagcactggacagccgagaccacgaaggacttgggaccctttctagtacttttctcaggagatgaattaagctctatagccacaaagtttcctgagatccttctgcaagcagcttccaagatggccaggaccctgcccactaaagaattcctctgggctgtctttcagtctgttcggaacagcagtgataagatccccagctatgaccctatgcctggttgccatggagtcgtggccccctcttctgatgacatcttcaagttggccgaagccaacgcctgctgggccctggaggacctgcggtgcatggaggaagacacattcatcaggaccgtggaactgctgggagctgtccagggtttcagccggcctcagctgatgaccctgaaggagaaagcaatacaggtttgggacatgccatcttactggagagaacaccatatcgtctccctggggcgcattgctctggctcttaatgagagtgagctggagcagctggacctcagctccatagacactgtggcttccctaagctggcaaacagaatggaccccgggacaggctgaatccattttgcaagggtacctggatgattcaggatacagtatccaggacctgaagagctttcatttggtaggacttggtgcaaccctgtgtgctataaacatcactgaaatcccacttataaagatctcagaattcagggtggtagtggccagaattgggaccctgctctgcagcacacatgtcttagccgagtttaagaggaaggctgaagttgtgtttggggatcccactgagtggaccagttctgtcttgcaggagcttgggaccattgcagctggattaactaaggcagagctccggatgcttgacaaggatttgatgccatatttccagccatcagcaataaaatgccttcctgatgagatattcaaagagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggagctctccagtcgtggggtcttggcttggttgtcccctgctggttctaatggccaagctcctgtggtgagtggcctgagcgcatcgtcctgtgttgccccaagcagctggccaacatgtgtagagacaggatgctccagatggtgggacacccttccctggatccagaccctcatctagggcagggaaaccctggggccttgatggtgaaaatgcaccccaaatgaaaaataattattaaaaatgatcttgcaaatt

SEQ ID NO: 1434 - DNA, 1884 bp, Homo sapiens
atagatgaatagaatgagcaaaagttgcagcacagcgtgtcaccagagaggaaaagaatatccttgctgtgccaagaaagaaaagaccatggatctactagttgcagatttcagcagtaatgccaagggggcaagaagtgaccagcagtacaattaggccatggcaacagaagccaactacaacccatgttccaatctatgacctccctctcctgctggtacaaggatatggactagcctagatgatgatggctcaccaatttccttgcaagggcaagagctgataatcaactgactaatgaggattgacttctacaattgatgagcatggaattggatgtgcctaaatcaacagaagagggattttgatgtcatcacactgtagccccagaagacagaacgctcaaaggtgtcaatgggcagaatttgtagatgacatacagcatccaatggattactcctattcagtattccttagagcaaaggatgcaatgtcaagcaagttgtgatacctcaactatctacaatttaacaccaaggaaagaacactgtttggagaaatgagaaagattatcatcagtgtctttcagaagtcatcaaaagaagaaaaggagaaaagagaggagaaagcagaaagatctggagtctgggaagttcaagagcatggcaccaacatctggcaagggctttcattctgcatcatctcatggaggaaaataaaaaggaggctggatgctcctgtgaagtacgtcttttatctacttgctatctttgcaattccttcatgctacaatgagagatagagtttaaacctgaaaacattcttggaaaaggaatcttcattaattcaaatataccacaagattcaccaccatcactactctaagtatttttcttcttgagaaagagaaggagagggaaagcaaggaagaggaagagaaagagaaatggataaaaacatggtcaagtagaagagtctgtgatttcaggtaaatccagatttggagcttaaatgactcaaatgctttgcctacattgatcctacattcaggctgcttacatatctcttggcttctctgagaaccagattgtcaccacttaaagtgtcttccagagtcctcacgagtatcagagaaggcataatctgtacacgtggcttcatttaaaatgaaaatatcaagcagtgtcattttcacaagtatccccacactgtctgaggctgaaaagaagagtgtagctatgcacactgcagtgagaagaaaatttcagctcaattggaggatgtaaagattgaaataccactgctcctagttctgatgcaaaattgaaaagagtgcactgggtcttcaaatggcatattgacaaggagaaagaggaaaggatgccccaggacagcctgggggtcaaggctgggctcaggcatgcctggacaagccatgcaagttgtctccggacttgaaccacgtatcagaggagctatttgaggaggcacatcagcatacctgcttctgtgggcccccaggctgtggtgctcagcccttgcactatgaaacattttttttttccagaagccaaagctttgagcatctcctcccatgtagagagtgtatatgtttacgtccatgtctttcgccatgtgaacgcatgcaaccaccacctcaaatatcataaatcctctctctccccctttctgtctgcctgtttatctacaatctgtctatttaaattctttttaaacaagaagggaatatctttatgcctgtttgtagggatattctacatccatctgttatttacatcattcgttttcctgaggtgtctccaacaaatcctggctggatgcactgtatgtgttattaataaaacagctgtaaaaatattaac

SEQ ID NO: 1435 - DNA, 2134 bp, Homo sapiens
atccgggtcaaagacaagggggctggagcgaccgaggggcatgttctgttgatagaagattctggagtgtggacagttaaaactttttgtgggcttcgaagttaacatgcgaatgtgtgtcagtatccgactctgagtgggccacaggctgccctgggtacagggaaacgaggggggtgggagcctgcggccagcgttccaggcctctgccagcgccgcatctcgacgctacagagccaagctcggggatcggcatgaggaccccagtaccagcagtagccacacccgcctccctcggggctgtttcccgtcctcctcagacccgctcaccgtgggctcctggcggcctctgcagcttttcagcaagcagagatggtgggcgccactcgccgatcctcacaaaccaaaacctcgcgcgacaaaaacgaaggcggccccggaagtgcgtcatcacactgactggtgaacccatacactctctggatttctctctaggactcgtggaggaccccacatcttggtgcttccctcctaattcccgtgaggaaaagggcacgctggcgagataggctcttggcgttcctccagagcccagttctgagttgaggcaccttgctcatgacgctgcatcatcgtaccaaccttgaatactggcttccagtgcctttattactgtgctacaataactgcaactacaagtcttacccagaatatgcaagaaaatgtgaatggttatacgttttattgatcttgttaaatttagcatttggattgttatagcataatgaacgaatcacacattatacaaccaggacttctcttgaattgctgtaatgattgcactcctagaatgtgatgtctttcaatgttgctgacgcctctcacttccatacattaccactagcagagaggattagcaatggaccatgggcaaagtgagagcagtcagtttacccaagaaatattcatcccctgtccagcagagcttaacactgtcccaggaaaacagcatgactacatcaatcagagggtttttaaaagtgtgattctttttgaaaaatcaagaaattcaccttctcacgatgtagaaaactgaaaagtgcatggcctcacccttacaacaacaaaaaacagccagataatctaaaattttctcttgaacacatcagaaagctaagatctgggggcaaacgacttaatctaaaatctgatgtaagacaggcactttcaagaagagatggttgtaagcacttgtttacataggacagatgccattggatgccatgtaagctgttaaggagaaatcagctaaaatgtttaatgagttgctgaggtcctagtgttggctagcctgagaatatagagactacagaactcctgtgaaccacagacacaagcagaatttccacccacttgtatattcttctctatggacatcatcaaatgtgtgcacacacacatacacacatacaattgaaggtaaggcaagaagaatcttatgaaaaccttcccgctagaaaagacatgaatccccatccaggtccttctctcctatttcccctacagaacaaaagccctaagcctctgaggatgaaaaagcaaatcttgtcacccttagggactggttaagatccagtggaactgaagggaataaagagaacaaaaagctctccattcacgaaatagcggtagaattgcatcctggttccagaccatggaggtgtcctacagctgaggatagggcaacatcacttaatagaccccacccttaagtctcagagacacagtgcctacctaagattaaagctgaatcacaacagaaaatgccatcccttctaccaccaccaaaatatcaaatgctgagtcaataagaacagcaatctactgctaaaagaaggataaaaacatggagaaagacccctctctgaggtacaggaatgaagggaaggcctaaaggtaagagtggtgcaaacattgagaaaatctcctttagcaaaccatcccacacactaaacttaaggtaatactagaagaatttgaagcctgtggataaccatagcaacaaaaacacctaaacacagtttaactcctgattagatcaactcaagccttcacaataaagatctaccgaaag

SEQ ID NO: 1436 - DNA, 1859 bp, Homo sapiens
ttcctgcttaccacgtgctcacagagtaggctgcggcaccacgtgcagccgctctcgtgcaggcgtttgcagtgtgcagctgagttcggcagctcacacagcacccctttcaagttgttttgcagtgggtgcctcttgtgagacactgtttctgagagcagcttttgtggcatcttacagggcagatttctggtcccacccacctctgcctccgccatggcttcaagaaccgttatcattgaccacgggtctggctttttgaaggctggcacggccggatggaatgagcctcagatggtcttcccgaacatcgtgaactacctaccgtgcaaggagaaccctggccccagctatgcccgtaggcgtgtgagcctgggcatcgacatttgccatcctgacacctttagctaccccatcgagcggggccgcatcctcaactgggagggtgtgcagtacctctggtcatttgtgttggagaaccacagacgggagcaagaggtcccccctgtgatcatcacggagacacccttgagggagcctgcggaccgaaagaagatgctggagatcctgtttgagttgctgcatgtcccatcggtcctcctggccgaccagctgcagatgtccctgtatgcctctggcctcctgaccggagtggtggttgattctggctatggcctgacccgcgtgcagcctttccaccagggccgccccttgcccgccagcggcaagacgctggagttcgccggccaggatctctccgcctatctcctcaagagtctctttaaggaagattgcgatagacgctgcctgtttcagctggagacagtcgccgtgactcagatgaacaagtgctacgtgccgcagaatctgggggaggccctggactttcgtgagaggcagcagagtgccttggatgagagcaacacctatcagctcccagacggctcccgcgtggagctgacccccatgcagcgggtggctcctgagatgttctttagcccgcaggtgttcgagcagccggggcccagcatcccacgggccattgtggaatccgtggagtcctgcgagatctccctgcgccccctgctggtctcccacgtgatggcctgcgggggcaacaccctctatcccgggttcacaaagcgcctgttcagggagctgatgggggatcacgtctcctccaccaaggccacagtctgggagggttccaatagaaactttagtgtctggctaggagcgtccgtggtggctcacctttctacctaccagtctgagtggatgtcccgagaggagtatggtgagcatatgaggatgtgaccctactggctcactcctgagaatgggctcctgttagatgggcacgggcggattaattttagcaaaatgttctgggtgggggtagaatgaggtggggtggggtgagctggctttggaattctaggggcatgagggtattttttaggttctaaggttttatcttgttgcaagagtgggacctacccaagggggaagacaagatgtcatccttggaaaccctgcaggggacagtttttccagggtggcctatcattggggtatgagtggctgactgccatctccatgcctgagagccactgatttttcattggcatttcccctggtttgtctcattcttcttggttgagtaggttttaactggggtagcactcctgctaggagtcccaattatttttgactaggggatgggggacagttgacatttctggtcctacaggccctttctggccagggaggcattgctgcaggtgagcctgggatgcccttgccacccgtggttggatcttgttttatatctgcaaataaatagcttgtttggaagc

SEQ ID NO: 1437 - DNA, 1961 bp, Homo sapiens
gaggtaaccctgaggtctgcccaccctacagatggggctttgggggtttgctccagagctcttcatccgcctgggcccaaccctggaactattcctttcaatggtgtcttttcttgccttgtttcagaaggatctactagttggccctatcttgtgccaagactgacagcaaggaagctgctggctgactgccatgtccacgcagagacttcggaatgaagactaccacgactacagctccacggacgtgagccctgaggagagcccgtcggaaggcctcaacaacctctcctccccgggctcctaccagcgctttggtcaaagcaatagcacaacatggttccagaccttgatccacctgttaaaaggcaacattggcacaggactcctgggactccctctggcggcgaaaaatgcaggcatcgtgatgggtcccatcagcctgctgatcataggcatcgtggccgtgcactgcatgggtatcctggtgaaatgtgctcaccacttctgccgcaggctgaataaatcctttgtggattatggtgatactgtgatgtatggactagaatccagcccctgctcctggctccggaaccacgcacactggggaagacgtgttgtggacttcttcctgattgtcacccagctgggattctgctgtgtctattttgtgtttctggctgacaactttaaacaggtgatagaagcggccaatgggaccaccaataactgccacaacaatgagacggtgattctgacgcctaccatggactcgcgactctacatgctctccttcctgcccttcctggtgctgctggttttcatcaggaacctccgagccctgtccatcttctccctgttggccaacatcaccatgctggtcagcttggtcatgatctaccagttcattgttcagaggatcccagaccccagccacctccccttggtggccccttggaagacctaccctctcttctttggcacagcgattttttcatttgaaggcattggaatggttctgcccctggaaaacaaaatgaaggatcctcggaagttcccactcatcctgtacctgggcatggtcatcgtcaccatcctctacatcagcctggggtgtctggggtacctgcaatttggagctaatatccaaggcagcataaccctcaacctgcccaactgctggttgtaccagtcagttaagctgctgtactccatcgggatctttttcacctacgcactccagttctacgtcccggctgagatcatctccctggtgggctccgtgagcagcagcgccctggccctcatcatcccaccgctcctggaggtcaccaccttctactcagagggcatgagccccctcaccatctttaaggacgccctgatcagcatcctgggcttcgtgggctttgtggtggggacctatgaggctctctatgagctgatccggccaagcaatgctcccatcttcatcaattccacctgtgccttcatatagggatctgggttcgtctctgcagctgcctacccctgccccatgtgtcccccgttacctgtcctcagagcctcaggtatggtccaggctctgaggaaagtcagggttgctgtgtgggaacccctctgcctggcacctggataccctgggccaggtaacctgagggcaggggagaggtggggtggcagacacgcagaagtgctactagtgacagggctgccatcgctcacctgtacctatttacacccagaactttccagctccccctcatcatgcctcctccttcctacctgcctcccctctgctggtgcacctcgcccaactcattcttactgcacagttcactttatttaacaattttcatgtcccccacctcatgttttcaccttttctgggccaggcatagattaagtaactgggaacgccccctctttataaagctgggcttctttctcatctctctccc

SEQ ID NO: 1438 - DNA, 1908 bp, Homo sapiens
aattttaccccaggaagagatgcaggaggcgatttttacctcagatgttgaaatttacactgctttgaaagaaagaagatatgttttcagcattgaaatatcatgcaatagactatttatatgagaatgtggttagaaagaagttttacagagatgctttattgcttcgaatcccttcatgtttatatcaagatgaaagttaccatgtagcagttactgataataaatttaggaggccatggacgagagtctcagctgtttcagttccgggaatgacagatacctcagtcttggaccaatggaaagcaagtttctttgtggaggatttccttgagaaaaaaacaattacaagaatggtgacccagattaattgtgaatttgaggaagttgttccaagttcaaatccagactcccaaattgaagtagaggaggtcagtttatacacccacatggactacaatgaagtctttacccctgtcagttgtttagaaaaatgttcagcacttcaaaaccagaaccaagatttatttattgatgataaaggaatactttttgtaagtagtagaaaacacctaccaactttgcctactctcttgagtagactaaaactgtttttggtaaaggatcctcttttagatttcaaaggacagatcttcacagaagctaatttttccagggaatgtttctctcttcaagaaactttggaagcttttgtgaaagaagatttttgtatggataaagtgaacttttgtcaagagaaactagaagatacaatatgtttaaatgagccgtcaagttttcttattgagtatgaattcttaatacctccaagcctcaaaccagaaattgatattccatcactctcagaactgaaggagttattaaacccagtgccagaaataataaactatgtagatgaaaaggaaaagctttttgaaagagatcttactaacaagcatggaattgaggatatcggggatataaaattcagctccacagagattttgaccattcaaagccagagtgaaccagaagagtgcagtaaaccaggagagttagaaatgccactaactcctctattcctaacatgccaacattcttcagtgaattcattacgtacagaacttcagacatttccattatctccggtttgtaaaattaatttgcttactgctgaagaatcagctaatgaatactacatgatgtggcaattagaaagatgtagaagccctttgaacccatttttgcttacagtgccaagaattcaagagccccacagccaatattcagttacagatttgaaaaagatattttctgttaaagaagaaagccttgtgattaatctggaaaaggcagagtggtggaaacaagcaggactaaatctgaaaatgatggaaacattggaacatctgaatacatatttatgtcatgataatttgtcttctaatgacactaaaattgagatatttttgcctacgaaagtgcttcaattagaatgtaagtacatcacagtaaatattagttatgtaaacattttcagaatgtgaaaatgttagattctggatttcctctaggtaattgggaaaatcactaggttctagcattccatataggccctggctctgccagaatttatgactttggatttctctaggtcccattttcttgaaaaaatgatgaagtttgactagctaaccctaaaatcttgttatgtcctaaaattctatagtctcagtttttaaatttctagccattttcatttaaagtgactttgtttccttttataaatgattaaattgctagcagtttccgttcacattggcctagacgcaaaccagcattttgcagtaactgttttttgacctaacagctgaacattagcattcaataatatcactctttaacaat

SEQ ID NO: 1439 - DNA, 2884 bp, Homo sapiens
agcaacgtcagggccagggccgcgaggtagttggcagaggcctcggggtcctcctggaaggggcctcatgacagattcggacgaggatgccctgaaggttgaccagggcccctcacgggacatcccaaagccatgggtgattccagcccccaaagggatcctgcagcacatctttgggaccagccacgtgttccaaagcatctgtgatgtaaaaccaaaggtcacagggttaacagtgcccctcaaagtcagggaatactactccagaggccagcagtgcttggagcaggcagactgggagacagctgtgctgctcttctcccgcgcactccacctggacccacagctggtggacttctatgccttacgggctgaggcctacctccagctctgtgacttctcctcggccgcccagaacctgcgaagggcctactcattacagcaggacaactgcaagcacctggagcgcctcacctttgtgctctacctacagggacaatgcctttttgagcagtgtgccttcctggatgccctgaatgtcttctcacatgctgctgagctccagcctgagaaaccatgcttccgttaccgatgcatggcctgtctcctggccctcaagcagcatcaggcctgcctcacgctcatcaccaacgagctgaagcaggacaccaccaacgccgatgtctacatcttccgggccagactctacaactttctccagaagccccacctctgctaccgggacctgcacagcgccttgctgttgaatcccaagcacccgcaggccaggatgctgctccagaagatggtggcccaggcccagcaggcgcgccaagatgcggggatcctggctgtgcagggcaagctgcagcacgcactgcagcggatcaaccgtgccatcgagaacaaccctctggaccccagtctcttcctcttccggggcaccatgtaccgacggctccaggagttcgatggggcagtggaggacttcctgaaggtgctggacatggtgaccgaggaccaggaggacatggtgcggcaggcacagcgccagctgttgctgacctacaacgactttgccgtgcactgctacaggcagggcgcctaccaggagggcgtgctgctgctgaacaaggccctccgggacgagcagcaggagaaaggactctacatcaaccgaggcgattgcttcttccagctgggcaacctggcctttgccgaggcggactaccagcaggcgctggcgctgagccctcaggacgagggcgccaacacgcgcatgggcctgctgcaggagaagatgggcttctgcgagcagaggcgcaagcagttccagaaggcagagaaccacttctccacggccatccggcacaacccccagaaggcccagtactacctgtaccgggccaagagccggcagctgctgcagaacatttttggggcccgccaggatgtggccactgtcctgctcctcaaccccaagcaaccaaagctgtccctgctgatgaccaacctcttcccgggcatgtcggtggaggaggtgcttagcacccagatagcccacctggccaggctgcagctggagcagatggtggagggcagcctgcaggccggcagcccacaaggcattgtggggatgcttaaacggcacgagttggagcgccagaaggccttggccctgcagcactcatggaagcagggggagcctttgattgcgacctccgaggagctgaaggccacccctgagattccgcaggtaaaaccgggaagctcagagggagaggctgaggcccctgaggaggaggaagaaaaggagaaggagaaaaaagaggagaaaaaatcagagctcatacctagcaaggtggcgtccctgtctgacagctaccttgaccagacctcttcagcctccagcatgagcttcaggaccacaggcacctcagagactgagatgtcggctatctgccaggaatacaggagcacctcagccaccgccgtgacattctctgactcgtcactgttgaagacgcaatcctcggactctgggaacaacagggaggcactaagccatggtcccagaaaaatcaaggccacccagggccagaggcagagccttagcaagactgagcccacccagagccagaggcggaactccagcaagaccaaggccactatacacaagaggaactccagcaagaccaaggccacccaaagccagaggcggaactccagcaagaccagggccacccagggccaggggcagagctccagcaagactgaggccactcagggccagaggcagagctccagcgagattgaggccacccagggcccaaggcaggagcccagcaagaccaagaccacccggagcccaaggcagaggcccagaaaggtcaaggctgctcgtggccggagctggagacccagcaaggttgatgccacccagggccgaagcaggggactgctccgaagttccaccaagactgaggctttctatgactcaaactggagcctcagcaaaactgagtatgcccaaggccagggccagaggtccagcaaggctgagggtgcccagggcaagagccagggcatgagctcaacttccagcaaggccgagtccacctggggacccagcccaagtctcagcaaaactgaggttgatcaggacctcacctactatgaagctgtctgaagggaccatccagaccctcccttcttgctggggaggggacgagttctacccacctccccacactggcactcagccagctgcctccttccagagcaattaaaagtcttagcaacagtcctctggtcccacagctgagtttattatacttgttttcttttacaaaattaaaaacatctaaaaccaggcccaagtggc

SEQ ID NO: 1440 - DNA, 2401 bp, Homo sapiens
gcaagcctgggccgctcctccttccctcaagcagcccgacggccatggaggctgaagagacgatggaatgccttcaggagttccctgaacatcataaaatgatcctcgaccgattgaatgaacagcgagagcaggaccggtttactgacatcaccctaattgtcgacggacaccattttaaggctcacaaggctgttttggctgcttgtagtaagttcttctacaaattctttcaggagtttacccaagaaccattggtggagatagaaggtgttagtaaaatggcctttcgccatttaattgagttcacatatacagcaaaattaatgatacaaggagaagaagaagccaatgatgtatggaaagcagcagagtttctacaaatgctagaagctatcaaagcccttgaagtcaggaacaaagaaaactcagctcccttagaggaaaataccacaggaaaaaatgaggccaaaaaaaggaagattgcagaaacttcaaatgttatcactgagtcattgccatctgcagaatcagaacctgttgaaattgaggtagagattgccgaaggcaccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggagcacatgaaatcacactccactgagagtttcaagtgtgaaatatgcaataaacgatatcttcgagagagcgcatggaaacagcacctaaattgttaccgccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagtcaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttttccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttt

SEQ ID NO: 1441 - DNA, 1949 bp, Homo sapiens
gttgctgggcggagtcagagcagttcttgaggttcaaggaggcgggggagacctgagctcacgcttgctgagacagaagtcacagcaggattatgcccctcagggcaagaggaagagttcagaaactgccgccgtaacccaagaacaaagttgcatgcagagccaacctaagagcttcaaaatcgggattccttactgagaaagatgtataacataaaacagtcaacagataccaaggaagcagcagccatcgaggctagaagaaatcgagaaaaagagcgacaaaaccgattcttcaatgtgcggaaccgagtcatgggggtggatgtccaggccctgaacaaccaggtgggagaccgaaagcgtcgggaagcagcagaaagaagcaaggaggcagcttatggtaccagccaggtgcagtatgatgtggtagtccagatgttagagaaggaagaggcagatcgaacacgtcagctggccaagaaagtccaggagtttcgggagcagaagcagcagctcaagaacgggcgtgaatttagtctttgggatccaggccaagtctggaaggggcttccaacctatcttagttacagtaatacctatcctggtccagccagcctgcagtacttctctggggaagacctagacagggacacacggctgagaatgcagcaggggcagttcaggtacaacttggaaaggcaacagcaggagcaacagcaagccaaggttgatgagaattatacaggtaagcagcccggccctccagactcagagacctgaggcctagtggggatctgtcctaagctgagtacagcagccaggggaccagaactgtgtggggaggtccacttatccatagggttggtgctgaaatgttaggttgtgcagaccccaacctccctgacttccttcagtaactgacagtgtagcattgttcttgattagtttggcactccattacgtggaggcagcacagtgcagacagacctaatggctctgccacttactagctggtttgggcaaatgaattttcccttctgtgcttcagtttcttcatctttaaaatgagaataataatttataccacatagagtagctactattatgatattgtctgtggccacatccttctcttccattagaagaagcccttcaagggcaaggaccatgtcttatctacttgcactgttcacccttcacatcaaccctgttacagcactctgttctgctggaccacttattgtagttgtagctaattgtgaaagtatttgtttaatatctgtcttctccctaaaatgtcagcctactgaagatgaaccatctctttcatgtctacccatctcccagttgcatagtacagtgtctgacaggtcttaggaacagcaaggagctcagtgtggctggagcagaaaaaaattgtcagtacctttgctcatgccatgccctcagcctggaatgccctttgctcttttagcctgtatacaaaatgtatttcaaggatcacctcttcctggaagccttcctcttttccaccatccaaaaccctcttaataccctgtgtacatccctgccattgctcttgccagattgtggtctatgtttgatctgtgtccccaactagacagggagttctctgaggacaggatttaattcgatggtatcattagaacccagcacatggcccttagactgagattcagagatatgaaatgatttacccaaaatcacacagctcagaagcagcagaactgacattgggacccaggtccattggaggcatcttttagttatgcgcttgagaaatcgttgttgctgcacctagttccttccacatccctacaactcggacactaaccccctcctaaacattcgtacacacacaaacacaaaacttgctgaacaaatggctggatgagtgaaacaggaatggagcaagccagtacagt

SEQ ID NO: 1442 - DNA, 2116 bp, Homo sapiens
atgtgatgcttctttgcacatctccaatcccagatctgacaagaggcgccggtacagcatgctgcactctcaggagtctggcagctctgtcttctaccactctcaggatgacggacccgggctggaaggtggagactgtgccaagaactcgggggcacccttcatcctagggcaggccaaaaatgcccggctagccagcggagactctaccaccaagcacgatctgaacctctctcagcgacggagggcatacagcaccaaccagatcaccaatcacaagcccctcccaagagccaccatggcaagtgaccccatgccagctgccaagagatacccactgcggaaagccaggctgcaggacctcaccaaccagaccagcctggatgtccagcggtggcagattgatttgcagcccttgctgaacagtggtcaggacctgaaccagggccccaaactccgtggcccaggggcccgaaggccctctctgctgccccaaggctgccagcccttcctgccctggggccaggagacccaggcctggagccctgtgagagagcggacttctgacagccgaagccctggagatctggagccgtcccaccatccctctgccttcgagacagagacgtcctcggactgggaccccccagccgagtcccaggagcgagccagtcccagcaggcccgccaccccggccccggtgctgggcaaggccctggtcaaaggcctgcacgacagccaacgcctgcagtgggaggtgagcttcgagctggggacccctggaccggagcggggcggcgcgcaggatgccgacctatggagcgagaccttccaccacctggcggcccgcgccatcatccgcgacttcgagcagctggcggagcgcgagggcgagatcgagcaggggtccaaccgccgctaccaagtgagcgccttgcacaccagcaaggcctgcaacatcattagcaaatacacagccttcgtgcctgtggacgtgagcaagagccggtacctgcccaccgtggtggagtaccccaactctggagctgccctgcgtatgcttggctctcgggccctggcccaacagtggaggggcacctcttctggctttggaaggccgcagacgatgcttggagaagattcggcaccaggaaatggtcctagaaagtgctcacagacattgatgggttttaaaacaaaaacagaaacagaacacagtgtgagggggtggaaacccagaggagctcttcagaatcaaagtgttctctcaacttcttggtcccattggcctccaaaacccaggagaaccagctccacccctgagccaagctgaacttccagtcttcaggaaattgctgacatggaggcaagtcccactgctctcttcagcgaggccaggtcccccggccgcgagaagcacggtgcttctgaaggtccccagcgcagcctggctacaaatactctttcttccatgaaggcctcagagaatctctttggatcctggctaaatctcaacaagtccaggctactgacgcgagcagccaagggcttcctgagcaagccactgatcaaagctgtggagtcgacctccgggaaccagagcttcgactacatacctctggtgtctctgcagctggcctccggagccttcctgctcaacgaagccttctgtgaggccacgcacatccccatggagaagctcaagtggacgtcccccttcacctgccatcgagtgtccctcaccacccgcccgtctgagtccaagaccccgagtccccagctgtgcaccagctccccgcctaggcacccgtcctgtgacagcttctccctggagcctctggccaagggcaagctgggcctggagccgagggcagtggtggagcacactgggaagctgtgggccacggtggtggggctggcatggctggagcacagttcggcctcctacttcactgagtgggagttggtggctgccaaggccaactcatggctggagcagcaggaagtacccgaggaccgcacgcagggcacactcaaggccgctgcccgccagctgtttgtgcttctgcggcactgggatgagaatctcgagttcaatatgctctgctataacccg

SEQ ID NO: 1443 - DNA, 2314 bp, Homo sapiens
gacccagttccgaggactggagaggggatagaaccttgtgtccaaggaggtccttcaggagacctgggatgagtggtgcttccccaaaacagactcatggacattaaacatcatcagaatggcacaagagggcaaagaagaaaacagcctcataccacggtgcagaggctcctgacctgggggctgccagtctcctgtagctggttcctgtggcgccagccgggcgagtttcctgtcactgctcttctgctgggggcaggcgctggggggctcctggccataggtctctttcagctcctggtgaaccccatgaacatctacgaagaacagaagattatgttcttgtacagcttggtgggcttgggggccatgggctgggggacctcccctcacatccgctgtgccagcctcctactagtacccaagatgctgggcaaggaaggcaggctctttgtcctgggatacgccttggctgccatctatgtggggccagtagccaatctgcgacacaatctcaacaacgtgatcgcatcgctgggctgcaccgtggagctgcagatcaacaacacccgcgcagcttggcgcatctccacggcccccttacgggccatgttcaaggacctgctgagtagcaaagaattgctgagagcagagactcggaacatctccgccacttttgaggacctggatgcccaggtgaatagtgagacgggctacacgcctgaggataccatggactcaggggagacagcccagggcagggaggcccgccaagccccagcctccagactccacctgtcgacacagaagatgtatgagctgaagaccaagctgcgttgctcctatgtggtgaaccaggccatactcagctgccgtcgttggtttgaccgcaagcatgaacagtgcatgaagcacatctgggtcccactcctcacccacctgctctgcctgcctatgaagttcaagttcttctgtggcattgccaaggtgatggaggtttggtgccgcaatcgcatcccagtggaaggcaactttgggcagacctacgactccctcaaccagtctattcgtggcctggatggggaattttcagccaatattgacttcaaggaagagaagcaggctggggtgctggggctcaacacaagctgggagcgcgtgagcaccgaggtgcgggactacgtgtaccgccaggaggcccggctggagtgggccctggggctgctgcacgtgctgctctcctgcactttcctgctggtcctgcatgcgtctttctcctacatggacagctataaccatgacattcgttttgacaacatctacatcagtacctacttctgccagatcgatgaccgcaggaagaagctgggcaaacggactctgctgccactccgcaaagctgaggagaaaaccgtcatcttcccttgcaagcccaccatccaggcctcagaaatgagcaatgtggtgagggagctcctggagacactgcccattccgctgctgctggtggtgctgtgtggcttggactgggctctctactccatcttcgacaccatccgccaccactccttcctgcagtactccttccgcagcagtcataaactggaggtgaaggtcgggggagactccctgctagcccggcttcttcgaaaaaccattggggccctgaacacctcctcagagacagtgatggaatcaaacaacatgccctgcctgccccagcctgtgggcctggatgccagggcctactggagagctgcagtaccgattggcctgttagtgtgtctctgcctgttacaggcttttggctaccgactccggagggtcatcgcagccttctacttccccaagcgagagaagaagcggatcctgttcctctacaatgacctattgaagaaaagagcagccttcaccaaactcaggagggccgctatcctgaggcgggagcgacagcagaaggctccgcgccacccgctggcggatatcctgcaccgcggctgcccgctcctgcgccgctggctgtgccggcgctgcgtggtgtgccaggcacccgagacgcccgagtcctacgtgtgccggacgctggactgcgaggccgtgtactgctggtcgtgctgggacgacatgcggcagcggtgcccggtctgcacgccccgcgaagagctctcttcctccgcctttagtgacagcaacgacgacactgcctacgcggggtgaagaggcgtcctgctcgctcttccgcaccgtccttcccggttaataaaatgccctgtacgcttaaaaaaaaaaaaaaaaaaaaaaaaaaaaaaaaaag

SEQ ID NO: 1444 - DNA, 2700 bp, Homo sapiens
aaccccgctaaacaagatggcgacctccgagagggctctcctgaggaccagagctgcctctctcctgagaggcttgggcagatcccgaactggagcccgatcgttacagtttcgcgcagaaaaagagcgtcagccttgctggtcttttcccatggggcagaagacgaaaggcagctctaacatagcctcctcctacctgctccagcagctcatgcaccgctatcaggagctggactcggacggagatgaggaccagggcgagggcgaggcgggatccgaggagtcctcagagtccgaaatgctgaatttggaggaggaatttgatggggtcctgagagaggaggctgtggccaaagcactccatcacttggggcgctcaggctctgggactgagcaagtctacctcaatctaactttatcaggttgtaatttaattgatgttagcattctctgtggatatgttcatctacagaagttggatctttcagcgaataaaattgaagatttatcttgtgtgagttgtatgccttatctcctagaacttaatgcttctcaaaataatttgactacgttcttcaatttcaagccacccaaaaacctcaagaaggcggatttttcccacaaccaaatttctgaaatttgtgatttgtcagcgtatcatgctctcactaaactaattttggatggcaatgagatagaagaaatcagtggactagagatgtgcaacaacctaattcaccttagtttggccaacaataagatcacgacaattaatggcttaaacaagttaccaatcaaaatactttgtctgagcaataaccagattgagatgatcacaggtttggaggatctgaaagccctgcagaacctggatctgtcccacaatcagataagcagcctccaaggcttagagaatcatgacctcctggaagtgatcaacctggaggataataagattgctgagctgagagaaatagaatacattaaaaatttacccatccttcgagttctcaatcttctagaaaatccaattcaggaaaagtctgaatattggttcttcgtaatttttatgcttctgcgattaacagaattagatcagaagaagattaaagtggaagaaaaggtttcagcagtgaataaatatgatcctccccctgaagtggttgcagctcaagaccacctgacccatgttgtcaacagcgtgatgcagccgcagaggatctttgacagcactcttcccagcctggatgctccttatcccatgctgatactagctggtcctgaagcttgtgggaaacgagagcttgcccatcgcctctgcagacagtttagcacttacttcagatatggggcctgtcataccacaagaccaccttactttggagaaggggatcgagttgattatcattttatctctcaagacgtttttgatgaaatggtgaacatggggaaattcattctaacatttagttatggtaatcacaagtatggattaaatagggacaccgtagaaggtatcgcaagagatggtttggcaagctgtattcatatggaaatagaaggtgtaagaagtttgaaatattcctattttgagcctcgttatatcctggtggtgcccatgaacaaggaaaaatatgagggatatttgcggagaaaaggattattcagtcgtgcagaaattgaatttgctgtctccagagtggacctttatattaaaattaatcagaattttccgggatattttgatgaggtaatcaatgcagatgatctggatgttgcctaccaaaaactgagtcagctcattagagaataccttggattgactgaggaacctgccaagagtttggctacaactgcagatgttaagacatcccacctgaaacctgaagcgcatcctacaaagtatatttcttcgaatatgggtgatttcctgcattctacagacagaaactacctcattaaattttgggccaaactttcagccaaaaaaacaccagcggaaagagattctatacacagacagcacgaggcagcccggcaagctctaatgggaaggatacgccctgatcacacactcctatttcaaaggggtccagtaccagcacctctcaccagtggtctacactattatacaactttagaagaactctggaaaagttttgatctttgtgaagactattttaaacctccatttggaccatatcctgaaaagagtgggaaggattccttggtttccatgaaatgttcattgtttcggttctgtccgtggtcaaaagaattgcctttccagcctccggaggggagcatttcttcacacctaggatcaggagccagtgacagtgagaccgaagagacccggaaagcactacctatacaatcattttcacatgaaaaagagtctcaccaacacagacaacactcggtcccagtcatcagtcgcccaggttccaacgtcaaacccaccctccctccaatccctcagggccgcaggtagactagcacttgatgtctgatcctaacatggaaaacctgctctgctgatgtcgaattccttgccttacctggccatgggtccagctgtttctcactcaacccattacccacggaagaatgttctacctgccttaattctatcagccagtttctcttgtgattctttggctggtgtcttttagttttttaattaaaaaattgtttctt

SEQ ID NO: 1445 - DNA, 1562 bp, Homo sapiens
ggagcgagaggcgctagctgccagctccagcagcccagatcgcgcagtatttctgcgtggcaccggtgcggatgcggctgtaaagcagtggtcaccgcctccgggagcccacttctatgtggagaggggagcacccagagagggtcttagggtgaaatttcaattttggcatatcactcagtgggtactgttgtgaccatggctgtgttaacactccctcccgaggagacttccctgccacaggcgctggagtcctcccatggcttcacagaagcagatggaggtagtgaccaaaggaactgggttccggcgccgccccaagaccatcacttacaccccggggacctgcgagctgttcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacggggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctaccagccttctgccacgtcaggtggtggcatagcactgccctgcagtaccccaaggcatactcagcagcctagcccctgccccggaatgcagatggagcctctgagactcacagccccgtccgcagagaagcaaagcccgagcatccctactaggacatgtgtctaaaggtatccactgggcctgcttcccaccacttctgacctgtggcctgttcatttagttttctgaattcaggaatgaatatgattcctttcttcctgttttaggatttacttatttgatttcttaccgccttaggcaagtattcaaccacaatgattaactggccaataaaacatatttaacgtgggtcattacaagcaccattttgttttcagagggataagcttatttgttcaaggcattagactttgtcaagcccagatggtttctagctacctgtttgcatatttcaagtggcaacgggaaccaacctcttgggcaccccatggctggctgctgtggcgggtgctgaattccactctgttaatgatctcaataaacctctgcaacggtt

SEQ ID NO: 1446 - DNA, 1459 bp, Homo sapiens
ggatcgcgtcgggcagcgggcgcggcggccccgcgcagccatggactggctcatggggaagtccaaagccaagcctaatggcaagaagcccgctgcggaggagaggaaggcctacctggagcctgagcacaccaaggccaggatcaccgacttccagttcaaggagctggtggtgctgccccgcaagattgaccttaacgagtggctggccagcaacaccacgacgtttttccaccacatcaacctgcagtatagcaccatctccgagttctgcacaggagagacgtgtcagacgatggccgtgtgcaacacacagtactactggtatgacgagcgggggaagaaggtcaagtgcacggccccacagtacgttgacttcgtcatgagctccgtgcagaagctggtgacggatgaggacgtgttccccacaaaatacgagaattccccagctcctttgagtccctggtgaggaagatctgcagacacctgttccacgtgctggcacacatctactgggcccacttcaaggagacgctggccctggagctgcacggacacttgaacacgctctacgtccacttcatcctctttgctcgggagttcaacctgctggaccccaaagagaccgccatcatggacgacctcaccgaggtgctatgcagcggggccggcggggtccacagtgggggcagtggggatggggccggcagcgggggcccgggagcacagaaccacgtgaaggagagatgagccccccgggccggacaggggcacacgtgtgcaaagagacggtggtgtgtgttctctcctgcatctgcgtgtgcacacatgtgctgggcacgcgtgtggtgaggtctgagagggccccgggctgcactggtgtgggctgcacaggcacagacgcagacggccccggccgtgtcctgtggccccctgtcggatggatgcgtgccgtttgtagagaagagcctttgggcccattcactcgttcagcagacacgcatgggactgatgctttgagttttcttctgtggggttttcctttctctggtctccgtgcagcccctgccctccctcgggtgctgctggcctcaaaggaggagctcgtggggggagggtgtgatttgcagacctgggtctctgctctgctctgggggtggggcttgctttcacagagaccctccttccctctcacccctcctctcccggcctcgccaggagtcttggctgttggcagctcagaggtgggggaggcctgtggtgtgaggtgccctgcacctgctcctgctcctgtcaccccttcctgctgcctcctccatgcccaaggaacacccatggtgcagtcctcaggcaaggccaggacggggctgaggccctgcgtggagatgctgcaccagcggaaggctgagacccgcttaccttagttcatctgttcactcgtaataaaaagaattctctc

SEQ ID NO: 1447 - DNA, 1955 bp, Homo sapiens
gaaggctccaatcacaaaggatgcccggttccacactcaagtctaatgccttcctaagctagtacgtttggacctgagaacacccctgagacgcctgtgagaatgtcctcatttcacaaatgaggacaggggaccagagagtctttaaggaaaaaagaaagagaaatctagttaggaagtggtggagctgaggctggaagccaggactctgataccggcccgcgcaccgccccaccccgcatcctggctccagaactccccgctgggacgcgtctctcctgctgcacctagcacagctctatgactcacgggtgttagagcaccgtgcttagggcagtgacaggactgtcagcagcctgagagtatggccgctaagtcaactcaggactccctaccccgagacacaggggagccctcagcactgcctgtacaagggagggcggagggaaggagcagtgaaggacggaaggaacgcactgctgagtgtgctctgcgtggcaagcaggcttcagagcctgctcttcgcaagaggaactttctgcctggcccaaacagtgacactgtgaggcctgctgcagagactgagctggtgccctgcagcctcagacacccacggcaggacctgtgtggagagcacccatccttcccagtcatgcagcctagcctagagacacaagcaaagccagaacgagacagggcagtgctcataccccccaaaggaccatggccccctgcacagggtctagccatgaggacccactgcccaacaggtcctccttcaaaagcgtattgcagaggcggcagcagctccaccagcaggaatcaggttgccagcttagcctatcgaacacaaaacactgctgcttcccagccaagtcaaccaggaggaagagggaaagaggatacagctggatatggaagctgcagccccagaagtttggctgtgtgactctgagcactgtatttggcctctgcctcagtgactttctcatctgtacaatggaccagtaatgcctgtaccttctgggttgctgtaaagcccaggataacttcagagaggcatctcacataatgacggctgctttaccatctaatgagtactaatcattaccttaaatgtttaagaggcaggtcttgctctgttgcccaggctggggtacagtgtcatgatcactgctcaatgcagcctcgaactcctgggctcaagcaatcctcctgcctcattctcccaagaagctgagtccacagacatgtgccaccatgaccagctaatttttatttactttattaatctgtttattttgagatagagtctcactctgttgcccaggctggagtgcagtggcacgatctcggctcactgcaaactccgcctcctgggttcaagcgattctcctgcctcagcctcctgagtagctgggattacaggcacccaccaccatacccagctaattgttttctgtatgtttagtagagacaggtttcactatgttggccaggctggtctcaaactcttgacctcaggtgatctacccacctcagcctcccacagtgctgagattacagacatgagccaccatgcccggccccgtaatcattacttaccaccaagaatgcctctcattccacactcatgaaccacatttgtctatcagttttaagtgttatgatggttaccctgcttgttattaaagcctgccaataacagagctgaaatatcgcagccaaaggcagagacacgtgctattccagaaagacccaactgctctgcatctgtgtcagcctccattactctggttcacaatgtttctctctcacccgcatcttctatttgtacctcgtggtcccccagattgggacccatgggactatttaatccaaaattttattgaaacattgttgccgcaaattaagttttttaaaaatgacaatagttaaattaaactggtaaaaag

SEQ ID NO: 1448 - DNA, 2066 bp, Homo sapiens
agactggagtacagtggcacgatctcggttcactgcaacctccacctcccgggttcaagcgattcttctgcctcagcctcccgagtagctgggactacaggtgcgcgccaccacgcctggcgaatttctgtatttttagtagagacggagtttcaccatgttggccaggctggtctcgaactcctgacctcgtgatccgccggcctcggcctcccaaagtgctgggattacaggcgtgagccacggtgcccggccaccttcgtcccttctacacagccggcatcagaacacaccatgatggctgtgacctaagaccctcaggaagccccggggtcatggcccagaagcaccccggagaaagagggttgtatggagcccaccacagtggtggtgcctccctcaggactttaggaccctccgtggaccctgaaataccttcattctcaggactcagggactcagcagggactgctcctaatggtacccgctgcctcacagagcactctggtcctaagcacacacagcacccaaacccagcccattggttggacccaagccatggccccccagggggtccaggaccacctagagatgcagaggaccctgatcagagtgagacgtcttcagaagaagaatcaggagtggaccaggaactctcaaaagaaaacgagactgggaaccagaaggatgggaactcttttctttccattccatctgcttgcaactgccagggaacacctggaattccagaagggccttactctgagggaggaaatggttcttctagcaacttttgccaccactgtacctctccagctttgggggaagatgagttggaagaggaatatgatgatgaagaatctctcaagttccccagtgatttttcacgtgtgtccagcggaaagaaacccccatcccggagacagcggcaccgctttccaacgaaggaggatactcgggagggtggacgtagggatcccaggtcccctggtcgacatcggctgggtcggaaacgaagtcaggcagataagcgcaaaggcctgggattgtggggagccgaggaactatgccccttctctttcctcaaatcaatgtcagggagccaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattctttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagacagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaacctg

SEQ ID NO: 1449 - DNA, 1681 bp, Homo sapiens
atagatccttcctgcctacccgcactgtccctgccctcaggccactccagcatccagcaggccagaaacctcagaagatttcttgcctcctttctctttcctccaggggcccggttcgatgtccccatctgcccacggcgcctctcgtgccagctgctccgcctgtcctgcccttgctcagaccacccaagtatcatctgtgctctggcccctggccaccaggtccaccccacatgctgtcctcacaggtggcgccttgccattcctggggaccagggcctccttgttctggtcatacacagtggagtgtaggtcgagcgacaagtgagtagatctgcatgccaggtgggccgagggtggccattccggcgtgagtgtgggggtgtgagggaacgttgcatggggtgcacgtgggctgggtgtggcgtgcagcggtgtggcgccaggcaggcagcttggcggggcccacaatcagcgcggttgagaccattagtacggttaaaaccgttagctgcctgtcgcggcgagggcggggccctggggactggacggaatcccagttggtcagaggagaccctgggggcggggccgcgcgagttgccgttaggacagttaaaaccgttagctgcctgtcgtggcggggcggggccctgggacaggacggaatccctattggtcagaagaggacctgggggcggggccgcgcgtgccgttgcagaggcagcgggacgcggccacctcgaagccacgtcagggcagccccaggtcgggcgcgtgccagcagccagaggtggggacaggagggctttgggcagggtgggttggggaaaggcggggggaggggctgaggagccggatggggccgtgggtctgggttcaggataccagcggtcctcccgggctttcccgggacgttggtcttgtagtccctcccctgccctttctttccctatggcgatggccgctctggctcttgaaggaggcttcacttccgcgcttatccttggagagcagttttcatccgattcgcaggggtccgcgacctcctatcccagatccccgcctggagttgaggagtgagaccgggtacgccccgggagccagagtgagcggagactcagagaagcccgctgggatttctctttgattatgagtagggaaaaccctgtgaggcctccggaaagacatcagaaggatttagtctaggagctcagagcgtgtctccaggtggagaagaggcggaaaatgagagaggcggccggccattagtgtttgaggcgggccggtggccacagggggcctgaagtctgagtaagagacctgattttttctgctagaactttccgcagtggaggaacgggaggggcacctggagggcctcacatcgcagcctcaagaatctcgcagtaggccggctgcggtggctcacgccacactttgggaggctgaggcaggcggatctcctgaggtcgggagctcgagaccagcctggccggcatggcgaagacccgtctctactaaaaatacaaaaattggcagggcgtggtggcgcatgcctgtggtcccagctacttgggaggctgaggcaggagaatcactagaacctgggaggcggaggtggcagtgggctgagatcgcgccactgcactccagcctgggcgacagagtgagactcggtctc

SEQ ID NO: 1450 - DNA, 1743 bp, Homo sapiens
agaaccagaaggcctgggggcgaggaacaggacctcggagtatttcaaggggagacctagttccctgccctgccccgggcccagggcgccgcggtctgaactctgctcggctgggggactcgtgatgccccctcctgaggaggcggccgcggtctctgcaccacccccggcccccgcggggactctgctgcccggcccgtctaaatggcaaaggcccgcgggcactccagttccccggatccgccgcctgctggaggcgagccatcgcggccagggcgaccctccgagcctccgcccgctgaagccgccgccgccgccccggcaactatccgtgaaggacactgtcccgagggccccatcccaatttccgccgcccctggagacttggaagccgccaccaccattaccttctgaacggcagccggcggaccgcagaatcactcctgctctggccacacccgcctcacccccgacagaaagccaggctgggccccgcaaccagggccagacggccggcagggctcgcggaggggcgcctccccatgcgggcgaaggcgaaatggcccagcctgcggattccgagtccggtctgagcctgctgtgtaaaatcaccttcaagtcgaggccctctttggcccctccggcagcctcgagttccttagcagccaaagcttcgctggggggcggcggaggcggcggcctctttgctgcctcaggtgccatctcttacgccgaggtcctgaagcaagggcccctgcctcctggagccgctcgccccttgggagaggtttctcgaggggcacaggaagccgagggaggtgatggagacggcgaagggtgctctggtcctccctcggcgcctgcgtcccaagcccgggccctaccgccgccaccctacaccaccttcccaggctcgaagcccaaattcgactgggttagcgctcccgacggccctgaacgccacttccgcttcaacggggctggcggaggcatcggggcgccgcgacggcgtgcggccgcactctctgggccttggggctcccctccgccaccaccagagcagatacactcagctcccgggccccggaggcccgcacctgccctgctggcgccgcctacgttcatcttcccagcacccaccaatggcgagcccatgcgcccggggcctccaggcctgcaggagttaccaccgctgccaccgcccacaccgccgcccacactgcagccaccagcgctccagccaacgccgctgccggtggctcccccgctcaccccgggtctgggccacaaggagtcagcctggctcccaccgcagcccctgctctgcccccagccttagccgccgaccaggccccggccccatccccggctccagctcccaccgtggctgagccctcgccgcctgtgtccgcgcccgcacccgcggctgcgcccatcaagacccgcacgcgcaggaacaagggttcccgtgcagcccggggcgcgacccgtgcttaactcctgtccctgcaagtgttactgccaccaccagccacgccatcgccgcctgccacgcaacgtctctgcctggctgagcacatccaaccacctgggcgagccaccctgggttgccaccatcaagctgtccggctctctggtggccaagctggagcactacgacttgcaggccacccattccaactgagtgtagtcggctcaacaccctccaccttcccctccatgccaataaaataaccaatccag

SEQ ID NO: 1451 - DNA, 1914 bp, Homo sapiens
gtgagaggtgggagggctggagaggtgtgggagaggcctgagagaggtccccctccaacccctcttggaggaatgaggccagcgtggttctagggtcaccccctttcaattcccagtccctcgcagttcattgtccaccctctctgggccctggcccgcctgctgtctgaagggtcttatatgtccatccctacaggagccccaccctgtttggccaggatgcctttgggacgcttggcagggagcgcccgctccgaggagggaagcgaggcatttctggagggaatggtggattgggagctgagtaggctgcagcgacaatgcaaagtgatggaaggggagaggcgggcctacagcaaggaagtccaccagcgcatcaacaagcaacttgaggagatccggcgcttggaggaggtacggggcgatctccaggtgcagatcagcgcagcccagaaccaggtcaagcggcttcgggacagtcagcggctggagaacatggaccgcctgctgaagggccgggcccaggtgcaggcggagatcgaggagctgcaggagcagaccagggccctggacaagcagatccaggagtgggagacgcggatctttacccacagtaagaatgtcaggtccccgggattcatcctggatcagaaggtcaagatcaggcgaaggatcaggatcctagaaaaccagttggacagggtcacctgtcactttgacaaccagctggtacggaatgcggccctgcgggaggagctggatctgctgcggatcgacaggaaccgctatctgaacgtggaccgcaagctgaagaaggagatccaccacctgcatcacctggtcagcacccttatcctctcctccacctctgcctacgccgtcagggaggaggcgaaggccaagatgggcttgcttcgggagcgcgcggagaaagaggaggcccagagcgagatggaggcgcaggtcctgcagcggcagatcttgcacctggagcagctgcaccacttcctcaagctcaagaacaacgaccggcagccggatcccgatgtcctggagaagcgtgaaaagcaggccggggaggtggccgagggcgtctggaagacctcccaggagaggctggtgctttgctacgaggatgccctgaataaactgtcccagctgatgggggagagtgaccctgacctgttggtgcagaagtatctggagatcgaggagcgcaactttgctgagttcaacttcatcaacgagcagaacttggagctggagcatgtgcaggaagagatcaaggagatgcaggaggctttggtgagcgcacgtgccagcaaggatgaccagcatttgctgcaggagcagcagcagaaggtgttgcagcagcgcatggacaaggtgcactcggaggctgagcgccttgaggcccgcttccaggatgtgcggggacagctggagaagctcaaggctgatatccagctcctcttcaccaaggcccattgcgacagcagcatgatcgatgacctccttggggtcaagaccagcatgggagaccgggacatgggcctcttcctgagcctcacctgtgtctcccggttcctttctctctgctcctgacactgcttttccctctgactcctgatctcctgttctctgggcttcctggtcagtgtctgtccgtcttgtctccatatctgccccttccctgtctgctgagccctggccccctgtggatcccccacctcctgtttccggctctctctcctcatctccatctcccaggctctccacgcatcctgtgtccctgtctctgtagctccttactccccaagagccccccagtgctgacaggtgtgggaaaagtcagggcgaagagccaggttcagcatgggaaaatgggactgtggaaataaagtatatgtgtgg

SEQ ID NO: 1452 - DNA, 1945 bp, Homo sapiens
agagacctgcctcaccagtgctgccgttgtgctgaaagacaaccatgaatgctgattttctgctgccgtattatacggcccagagtggctccagcatgagcatgttcaacaccaccatggggaaactgcagcgacaactgtacaagggggagtacgatatattcaagtatgcaccgatatttgagagcgactttatccagatcaccaaaaggggagaagtgattgatgtgcacaaccgtgtccgtatggtgaccatgggcattgcacgtaccagccccatcctcccactcccagatgtcatgctactggcacgaccggccaccggctgcgaagagtatgctggacatggccaggccaccaagagaaaaaaacgcaaggcagcaaagaacttagagctcaccaggcttctgcccctgaggtttgtacggatctctgttcaagaccatgagaaacaacagctgcgcctgaagttcgccactggcagatcttgctatctgcaattgtgtcccgctcttgacacacgggatgacctctttgcctattgggaaaaactaatttacctcttgcggccacccatggagagtaacagcagtacctgtggcattccagctgaagacatgatgtggatgcctgtgtttcaggaagacaggaggagcctgggagccgtgaaccttcaaggaaagggggatcaggaccaggtcagcatccaaagcctccacatggtctctgaggtgtgtggggccacctctgctgcttatgctggaggggagggactccaaaatgactttaacaaacccactagtgtgctcaatgcatccatccccaaaacatctacagaacttgctgaggagccagcaacaggggggattaaagaggcagcagcagcaggggcagctgcaggggcagcaacaggcaccgtagcaggtgccttgagtgtggcagcagccaattctgcccctggacaggtgagcgcagccatagctggggcggccaccatcggtgcaggaggaaacaaaggcaacatggcccttgcaggcactgccagcatggctccaaacagcacgaaggtggctgtggcaggggctgcaggcaagtcctcagagcatgtttccagcgcatccatgagcctttcccgagagggcagtgtgagcctggccattgcaggagtagtactgaccagcaggacagctgcagaagcagacatggatgcagcagcgggacctcccgtctccacccggcagagcaagagcagcctgagtggacagcatggaagggagcgaacccaggccagcgctgaaggctgcaaggaggggagggaaagaagggaaaaggacagggctctcggaaggagttcccatcgccgcaggacaggtgaaagccgccacaaaacaaggggagacaagattgcccaaaagtcctccagcaggtcctcattcagccacagagccaatagagatgacaaaaaggagaaaggctgtggcaacccggggagcagcaggcacagggactcgcataaaggtgtcagccacacgcccatctcaaaggagtccaggacctctcacaaatctgggaggagcttatggaccaccagttccggttccagcaagggacttggcagggtcagctctttcctgaggaacgtcagagccaaccttactacaaaagtagtgggcacaccacatggcagagatgtggacgtcatggctaagatggcggagaggagcaccaacgtggccatcgccgagacagcagagggtggccaggggctggagacggttggttctatgacaccggacatcatggagacagtgacctttgaagcccattaaataagacccagagctggaagctgcaaaggagcccagagctcatgggagtgtccctggaaagcctattccagcgttctttactgccgtttaaataaagaatcatacatctgaaagtg

SEQ ID NO: 1453 - DNA, 1930 bp, Homo sapiens
ctcctatcctcccatcctccaggcctgtggtgtgacttctgccccgaagttcctactatagtgagtcatctggggagaggccactgaaaagaggccttcccttcccatttcctcccctgcctccttagaacacactctaagtcagaacttaatctaagaagaaggaagctggaccaggaaccttggaagtcagccagccctagaacagtcagcctaaattttggccgtaatggcttttttggttttttgttttgtttctgagatggagtctcactccgttgccaggctggagtgctgtggcgctatctcagcttaccgaatcctccgactccctggttcaagcgattgtcctgcctcagcctccggagtagctgggattacaggcatgcaccaccacacccagctaatttttgtatttttagtagagacggggtttcaccgtgttgtccaggatggtctccatctcctgacctcatgatgtgtccacttcggccttccaaagtggccgcaaagtggcccacttcggccaaagtgcacttcggccttccaaagtgcattacaggcgtgagccaccacgcccggcctggccttttttttttttttttttttgagacacagtttcactcgttgcccaggctggagtgcagtggcgcaatctcggctcactgcaacttctgcctcctaggttcaagcagttctcctgcctcagcctcccaagtagttgggattacgggcatgcaccaccatgcctggataattttttcttatttttagtagagacaggatttcatcatgttggccatgctggtttcgaactcctgaccacatgtggtccacccaccttggcctcaattatgtgcattttggtatatttacttgtatttcaacatcttgtgagtttgaaaaacctgaaaggccagaatgcttccttttatttctcaccatttgggcagcacctaagtggttttgtaaaatgcagcatctggtgctgtgggtctctctcaggccttgagggacacttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagactgaatctttagggtgaagagctccccaaagccatctggtgaggtcattgtggggaccagggactgattatttgtcacctggatcacaaagatgggactgtctgctcaggctggtggtgacaggatcctgacccgtggtcctctcccgctccctctgctccaccaggacacatgtataggacactgtgctgtgtgcagtggagaaatctccctgggccaggggaaagttcagacagtgcctctagattgtgttttgcctcctccaatgtagagttgacatctggaccccagagcccagcagggctttctgtcagacatgctagggtggtagaaatgggccctccaggtccccctgcagtgcactgggcagagacctccggaaagccggcagcgggagcgcttcctgggcagcttcccccagcacagtgttcccaaaccagtccatccggaaaacagtctgtacagcaaatgctgtgtgagatcttaggcttttcactttttttgttttgttttgtttttgaaagaaagaaaaaaatacaattaacaagcctcttttgtaaatgggtttcctttctatgtataaaatcgtggtggtcccttgtttttacatgttcatgctgtgtaattttgagatgttactgagatatgttctgaacataatgtgcatttttttctgtacagatgaaatgggagaatttaataaagagtttgcaggtttttacttgtt

SEQ ID NO: 1454 - DNA, 1992 bp, Homo sapiens
aatggaactaacaggaaccacctgtgcacttccttttacaggaatgttcataaacagcaggttctcctaggctttgaacaaaatttagcttctccgaggccaaaagcctcattgtgaagagaaagaaagaaacggcttacaaaatatacagatcttggtagacaacgtggctgcaggctgttgaattggaattccctgtggctgtccgaaggcagggtgtccggagagcggtgggctgacctgttcctacaccttgcatcatgccagctttgtcaacgggatctgggagtgacactggtctgtatgagctgttggctgctctgccagcccagctgcagccacatgtggatagccaggaagacctgaccttcctctgggatatgtttggtgaaaaaagcctgcattcattggtaaagattcatgaaaaactacactactatgagaagcagggtccggtgcccattctccatggtgcggcggccttggccgatgatctggccgaagagcttcagaacaagccattaaacagtgagatcagagagctgttgaaactactgtcaaaacccaatgtgaaggctttgctctctgtacatgatactgtggctcagaagaattacgacccagtgttgcctcctatgcctgaagatattgacgatgaggaagactcagtaaaaataatccgtctggtcaaaaatagagaaccactgggagctaccattaagaaggatgaacagaccggggcgatcattgtggccagaatcatgagaggaggagctgcagatagaagtggtcttattcatgttggtgatgaacttagggaagtcaacgggataccagtggaggataaaaggcctgaggaaataatacagattttggctcagtctcagggagcaattacatttaagattatacccggcagcaaagaggagacaccatcaaaagaaggcaagatgtttatcaaagccctctttgactataatcctaatgaggataaggcaattccatgtaaggaagctgggctttctttcaaaaagggagatattcttcagattatgagccaagatgatgcaacttggtggcaagcgaaacacgaagctgatgccaaccccagggcaggcttgatcccctcaaagcatttccaggaaaggagattggctttgagacgaccagaaatattggttcagcccctgaaagtttccaacaggaaatcatctggttttagaagaagttttcgtcttagtagaaaagataagaaaacaaataaatccatgtatgaatgcaagaagagtgatcagtacgacacagctgacgtacccacatacgaagaagtgacaccgtatcggcgacaaactaatgaaaaatacagactcgttgtcttggttggtcccgtgggagtagggctgaatgaactgaaacgaaagctgctgatcagtgacacccagcactatggcgtgacagtgccccataccaccagagcaagaagaagccaggagagtgatggtgttgaatacattttcatttccaagcatttgtttgagacagatgtacaaaataacaagtttattgaatatggagaatataaaaacaactactacggcacaagtatagactcagttcggtctgtccttgctaaaaacaaagtttgtttgttggatgttcagcctcatacagtgaagcatttaaggacactagaatttaagccctatgtgatatttataaagcctccatcaatagagcgtttgagagaaacaagaaaaaatgcaaagattatttcaagcagagatgaccaaggtgctgcaaaacccttcacagaagaagattttcaagaaatgattaaatctgcacagataatggaaatcaatatggtcatctttttgacaaaattataataaatgatgacctcactgtggcattcaatgagctcaaaacaacttttgacaaattagagacagagacccattgggtgccagtgagctggttacattcataact

SEQ ID NO: 1455 - DNA, 1758 bp, Homo sapiens
gttacgggcgaaaccttggtctgaaacatgcggccagagaaataaatctcaggatccggcaggtgtcaaaggtgacctcttcatcaacccaactgcctgcactattgtctgtagtccctgacaagagtaattatgcctcgaggtcagaagagtaagctccgtgcccgtgagaaacgccaccaggctcgttgtgagaatcaggatctgggagctacgcaggccactgtggcagaaggagagtcaccctcctctgcctatcttctctttggtgacagaccccagaatttgcctgctgctgagacacctagcatccctgaagcgcttcagggagccccatccaccaccaatgctattgcacctgtttcatgcagttcaaatgaaggtgccagcagccaagatgagaaaagtctaggttcctcaagggaagctgagggctggaaagaagatcctttaaacaagaaagtagtgtcgctggtgcatttcttgcttcagaagtatgaaacgaaagagccaattacaaagggagatatgataaagtttgttatcaggaaggataagtgtcacttcaatgagatcctcaagagagcctctgagcacatggagctggcacttggtgttgatttgaaggaagtggatcccatcaggcactactatgcctttttcagcaaattagacctcacctatgatgaaacaaccagtgatgaagaaaaaattcccaagactggcctcctgatgattgcactgggtgtgatctttctgaatggcaaccgtgccccagaagaggcagtctgggaaattatgaatatgatgggtgtatatgctgataggaagcacttcctctatggggatcccaggaaggtcatgaccaaagatttggtgcagctaaagtacctggagtaccagcaagtgcccaacagtgatcctccacgctatgaattcctgtggggtccaagagctcacgctgaaactagcaagatgaaagtcctggagtttgtagccaagatacatgataccgtccctagtgccttcccatcctgctatgaagaggctttgagggatgaggaacagagaacccaagccagagctgcagccagggctcatactgctgccatggcaaatgcacgttccagaaccacgtctagcagcttctcccatgctaagtgaaatctgaggcttgttcttcactttttggtcgaaaaggttacatttcaaatgttcaagtctgaagattgttttctttgtggaagagaagagcagtcaacattctaagtagtgaatggccagagtgcgtctggagggaacacagcatatatcattttgtgttaatagtctatagtaactcggagttgtatctttttctttcttttttttttttggtgttatatttcaaatgttgtttcttataatagaagttttagataacttcagaatctatatttattaatgactttggttacacacgtattgctatttaagagtaggagttttattgttctgtaaaacaaattgggaaaccttctttcatatttaatgagccagaacaaggaaacacagtattggaataggtatttccttaaaaaatgtgagatgatttagcagtaaaattttggagatcaaaacataggtgagaaaaagtaaacttttcagttcttggttttctttttccattttagtctgttatataaaaataaaagtcatacctggattggcttagcttactgaagaaggtaggaagaaataaaatgtttatgaaccagc

SEQ ID NO: 1456 - DNA, 1990 bp, Homo sapiens
acgacagcgggggggggggttagacgggaagttccgcctcagcctctcaatcagcggcggtgtcgcacttctcccgagaggctccggcgaggggcagggccgcgttcgtccgggacccgcctcaagcctcgcagcctttcacccagtttcctcccgattcttgctgggacaacaaaattgggaagcggttctcgaaacatactgtcaaggcgtagttgcatttggtcgcccaactcacattgaagcctaagacccagctgatttctcttcatttctgcaaagttactgtaccatggcaggccaacgaacatgtcaaaggaggagcagcagagctggccccgggaaaatgcaagaacctccaaagagcattgaagaattcttaaagtttcaaaattgggattattggccaagggaaatccattttagagatgatgataaatggtcatgcactctgaaaaaaatgaaagaagatagttcatttgtttcaatttatacacacctatgggaaaatgttcctcgaatatttgaagcacttttgatcatggaatcaaaattaaaggaatattcacttattttgcaaaaccacacctctgaaatatttaagtggaaaagcatgatttctgagacaagttcttatagaaaattggaacgatatggggaatttctaaagaagtaccataagaaaaaaaagataatgctttcagatgaaatggagacagagaagaatatagagggttgcagcttcacaggattcaaagcaaatgaacttactcagctacccagacatttggatgctgaacaaatttatctttttattttaaaagcccataattttgatgaaagagtttttaaaatctggaagactcattttctctcagaagcctccattgctcttttgcatgactccttttggtggtggtttctccataaatttaggcctgacagagaaaaccaagattgcttattcgatagaatttcagaaagttatgtgacacttttcatgagcatacctctaagtcgaaaggatgcattttttcagatatatcctgattgtttggcacaagccatatatgcaacgttccatgaagcatttccagaatcgagttacctctttaatgatgaatttaaagaagatctagggaataacatttttctttggtgttcaggtttaaaacctcaaaaaggcttttggatccactggaaactgaaagaactctccacaaccaccattcatggtagcaaaaaagcacctgcaaaatcagtaaaggaaagaattgcagacagtcaagaacatatatcaactagtatcgacttcaatattataaagattctgaacaacccaagagcatatacgttgcccatatccaaggaagaatcaagattatcaagactagcaacaaagtcgcactatagtagtactggtccagagtttaatcgtgttctcttcaattttggaggtcagagtccattgattttatattatcttaagatgcatgagctggctggtatttccaaagcacctaagaaaaccaagattaaactcactaagatattccaggaaccactacctgctccaacataccgtgatgttataaaggaggcaaaaagacaatttgcaaggaaccaaaaggattttaggatactccaagcaaaggctaccaagaaacctcatgaagtgaaacaggactttgagaagttcctacataaactgcgttccgaagctgaaattgagagagaatgtgtggcatcactatcgtcatcatcatcatcatcaccatcatcaacagacaactacaactttgaggaagaagaatactaagagaaaccagaaatgaactctattcaagaataatgcatacaattcagtggtatcagtttaattgtaacaatatatttaattcaagtccaatccatgtaatcagtattaagagtgtgttttaccattcatctttaaaatcttcaaatcaataaatctcagtaagttattctt

SEQ ID NO: 1457 - DNA, 1797 bp, Homo sapiens
ctgttctgttccccagcctgcctttgtatcacggatagaggagctgtttcataaatgagatgagttatgctttaaaccatacaaacagaaaactaacattggaacctaaaattactgtcaatgccaagatcattgtggttggtgcatccagtgttggaatttccttcctagagacattggtattttgctctcacatgaagtttaataatcttaccctgatttcaactcatggactcccaggaaaaaaacttctggacactgaacaaaggaaatttttagccagcgaccactgttttaatgataaagattatgcactgatgtcactgtgctcctgggttaatgtcgtggtgggtagaatgaccggcatagaccgagcagccaagcacgttgtgctttccacggacgagatcgtgccctacgaccaccccatcctctgcaccgggcagcagtaccaggtcccatgccctacagaggctgatattagtcaacacctgacaaacagggaggttcccaacagcagtcagcggcggtacacggggaaagttccttgcaaccatttcactctcaacgaggaagaggattgctttaaggcactgatttggataaggaataactccatcaccacagaagggaatatcattgtctatgggaatacaattgatacttacaccaccgtggagacgctcttaaaccttggcgtgagcggcagccgcatccacctcgtgcagcccccgcccgcctccaccatcacctgcatcaacaactactcggtggagagtgccgtggcggacgcgctaggagccgccggagtcactatgtaccgggatgcgatcctggcccagtggaatgacggcctgcacccagaccccatctacagcgcctccttcaccacacccaccaagcctttcagactccagtgctctggggcattcttcctgggtcttaccattatctgcatattgccaagcctgccattccaactcccttggaggtacaaatggcacagcctaattatggtttagaactagtaaccggcagtgcgaaaaatgggacttacttccgaattcatattaacaagtataaaatggtggaaaccatcacgtgcctttctagggagcccttccccgcctccaactacatccgcttgtttggccagcacgagcaactcctcaacaacctgtgtgctcggtacgatgaaaacctgatcacagatctctatagctacttcaccgagccgtggtgcctggccctgttccacgatcgttttattgatctcaggaaagagttacgccaaatcttagcctccaaggaggaggaagatcttccttccatagagcagttagcccatcaaatagaagatgaggaaatcaacccgactgagaagcccaggcaatacctcaaaagagtttttgaggaatccatctacaaaaccctggtggagagaagcactcttgactacctgcactataaccgctaccacctgcccatgtacgcgtggccaggcatcgtttagttgtaggcagggtctcccctttatggttttcatttatttagttcctggaaacgcgctctgtagaaatagaaaagttctctgcagcctggtttgacagcgaagccagcccctggtggttttgttcactcctttcctttcctgacttatgcctgtagttttctatcatcccagtaggtggcacacggccgtgtgcctctcttctggggcaggctcgctttacaaatcccaggcatgttcctgtgcagaataatccatttcagcaataaaatgagatcatactgtgt

SEQ ID NO: 1458 - DNA, 1902 bp, Homo sapiens
gtgttaagtgctacggcagcaaattgctacatgtgctggatatctcttgttttcccctccagctccactctgctcttgcccacaaagctgacccgaatggaccacagcagtgggctcctatgcctcctggcttctgagtgggtttggccaaggagtgtcctggccagagatcagaggatggtagggtgcctattctcggctcttctcctggggttggggggctgccttagcagccaaaggtcacttctcccaaactccttccctgctttccaggttgccagtccctgcactcttcctttctggccaaggatgatgtcagttctgctgctactagcctggagttgcagaagctactgtgcttcctctttgggtagcctatacctatacttatctcctcataatatcttcatgtaaagaaccatctgtttcttattggaatcaagaccaataccaaggagaaattcctagggaacaaaaattccaatgaggaattgacctctttgtcagatccttatcaccaaacattagaaaagatctcataactttatacagcatgttgtaagcattttgataactaaaatcctgttctagtgaatgtcatgcagataactacacaaggagattaatttaaatttgccttctttggcaagcccttaaaccaatggctaaagcagttagttgtgagtttctgagtaggtcccaatgcgtttatttcatttgtccaacctagcacagagatcctttgatactttaattgcatggcttttccaatcagacgaaatttcagtctgagagaggacatattttctgaggtttatagttttaggattgtccaaaaggcctatgatctcttcttagcatgacagaaagagggaaagataagttaaatttcaagggggtcatatcatcacactttggtcttatttcattttcaatgatttcctagatcactttaacttttttgtgtcatggactcctcagaataatgggttttttttgtttgtttgtttgtttgagatggagtctcactctgtcacccaggctggagtgcagtggcgaaatctcagctcactgcaacctccgcctcctgaggttcaagtgatcctcctgcctcagcctcccaagtagctgggattacaggcacatgccaccacacccagctaatttttgtattttttagtagagacagggtttcaccgtgttggcgagactgatcttgaactcctgacatcaggtgatccacctgcctcggcctcccaaagtgctgggattacaggcatgagccaccatgcctggccagaataatgtttttaaatgcagaaaaggaaatgcatggggttacaagggaaacgaattacactgaagtgtaagctaccaaataatttatgatgtggtagttataggtgtgcatttaatagccagatctacgagtggatgtaataactgctatgatgttgaagtagcataaaacatatattagatatctgcaacaactgtgatgtaacatgaaaatacctgatttctgttgacaaagttactgctagtacaactgtggattgttgtctgcactcgtcattgaaggaaatactaaattttagttttaggctagtgaaattaaagttaatttttcccatccaagttcatgtatcttctgaattctatccgtgaatcccttagaggtctgtgaattgtaggttaagaacccctgccctagctaatcagatccaccaatgtttcaaataggactataacttattcaaaggccaatgatacttcgcataattcaattttaatattattcacatttcatgtcacaaatttagtaagttacatgtgttatgtgatgttttgttttgatagattatatcttactcctaaataaaaagtcaagatttttgtagc

SEQ ID NO: 1459 - DNA, 2045 bp, Homo sapiens
agagcatgatggggcacgcgcggtagcgcgaggcggggcatgtaaccatagcgtgcgggtcatgatgaggcacggacgtggggggttaggtggggcacgtaattggagctcgcggggcaggatggggcatctagctggagcgacagagagcacgatggggcacttacaggggccggaggctggcccgggcagtgagtgtggatggcttggcaggtgagcctgccagagctggaggaccggcttcagtgtcccatctgcctggaggtcttcaaggagcccctgatgctgcagtgtggccactcttactgcaagggctgcctggtttccctgtcctgccacctggatgccgagctgcgctgccccgtgtgccggcaggcggtggatggcagcagctccctgcccaacgtctccctggccagggtgatcgaagccctgaggctccctggggacccggagcccaaggtctgcgtgcaccaccggaacccgctcagccttttctgcgagaaggaccaggagctcatctgtggcctctgcggtctgctgggctcccaccaacaccacccggtcacgcccgtctccaccgtctacagccgcatgaaggaggagctcgcagccctcatctctgagctgaagcaggagcagaaaaaggtggatgagctcatcgccaaactggtgaacaaccggacccgaatcgtcaatgagtcggatgtcttcagctgggtgatccgccgcgagttccaggagctgcaccacctggtggatgaggagaaggcccgctgcctggaggggataggggggtcacacccgtggcctggtggcctccctggacatgcagctggagcaggcccagggaacccgggagcggctggcccaagccgagtgtgtgctggaacagttcggcaatgaggaccaccacaagttcatccggttccactccatggcctccagagcagagatgccgcaggcccggcccttagaaggcgcattcagccccatctccttcaagccaggcctccaccaggctgacatcaagctgaccgtgtggaaaaggctcttccggaaagttttgccagccccggagcctctcaagttggaccctgccactgcccacccactcctggagctctccaagggcaacacggtggtgcagtgcgggcttctggcccagcggcgagccagccagcctgagcgcttcgactacagcacctgcgtcctggccagccgcggcttctcctgcggccgccactactgggaggtggtggtgggcagcaagagcgactggcgcctgggggtcatcaagggcacagccagccgtaagggcaagctgaacaggtcccccgagcacggcgtgtggctgatcggcctgaaggagggccgggtgtacgaagcctttgcctgcccccgggtacccctgcccgtggccggccacccccaccgcatcgggctctacctgcactatgagcagggcgaactcaccttcttcgatgccgaccgccccgatgacctgcggccgctctacaccttccaggccgacttccagggcaagctctaccccatcctggacacctgctggcacgagaggggcagcaactcgctgcccatggtgctgcccccgcccagcgggcctggccccctcagccccgagcagcccaccaagctgtagggccgcccggagtcctgccggcccacaggcccatcccggcggggcaccggggactcgcgggcttctgctgggtcccgcctgaggtgatatcgtcactgtttaggaaggtcttcaggcctgtgtgtccctggaacatgtaatgatagggaacaggaccccagtccctttcccctcagccaagggtgtatttgtaaacttcggcccccaggccttggcagccagggacacactgaaatccccatggttcctgccacttgctaaccatgctatctgcgcagacgcttccgagggcagaaatagtcccatgtataccttttccatattactgtgaactttcaactactatcaaggataataaatttgacattatttctttctcttt

SEQ ID NO: 1460 - DNA, 2429 bp, Homo sapiens
gagaaacccggagggcgccgggtattaccagggtgtgcagagaaggcagagctgcgtcttcctcttttatttttccgactgggccggggtctgcagggctcagctgagcccatgagctcccagagctaacccctgaacacccaggcgggcaaagggctgatgtcggtagtccccatcctggaggggcaggctctgcgcatctgctcctggcatggcgctgcggcacctcgccctcctggctggccttctcgtgggagtcgccagcaagtccatggagaacacggtcacgagaaacagcacagctgtgatcaacacacaagctgagggtaccctgagccccccaggcctgtccagtctgcctgtggtcagggaatgggccctcacacacaccgcccagctgcccgagtgctgtgtggatgtggtgggcgtcaacgccagctgcccaggcgcaagtctgtgtggtccaggctgttacaggcgctggaacgcggacggtagcgccagctgcgtccgctgtgggaacggaaccctcccagcctacaacggctccgagtgtagaagctttgctggcccgggtgcgccattccccatgaacagaagctcagggacccccgggcggccacatcctggggctccgcgcgtggccgcctccctcttcctgggcacgttcttcattagctccggcctcatcctctccgtagctgggttcttctacctcaagcgctccagtaaactccccagggcctgctacagaagaaacaaagctccggccctgcagcctggcgaagccgctgcaatgatccccccgccacagtcctcaggtaacagcagctgtcgcatccccctgtggggtttcccatctctgggccagtcccagggtgctctgtgggtttgtccccaaacgggtttgcctggctctggatctcggccacccctgcccgggtccccaggagacccacccacaaggcagggccagggccggatttggctggtgccccctgctctggatctcagctggatttggccggcgccccctgcccgcccccctttaatccccgtgacttccatgctctttcctgttcccgagacgtggggtttgcaggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccgtacggaagccgcgctacgtcaggcgggagcggcccctggacagggccacggatcccgctgccttcccgggggaggcccgtatcagcaatgtctgacctggaggccgagaccacgccacgcacttggcggcagggacccggaggccgaccccttggcgggaaccagcacaaagtgttggcatcgcccggcgcccgggacagtcctgggcacagcctcggctctgggtccctccgcctcccagcgacggacgccaaagggtcccgggccgcctgaggctcctccccaccacagccatctcgtttatcggaccaggagcaggcatccatgagacctcagagcttcagatcgaggccttggggggtccgggcccccccaggaaacacggtgaggccccagcgcctgcagccaaagctggcacgatctatggggcaggtgccgctctgcctagaaaagccaggggctctgctgccgtgccctccagagcccacagcgggcaggactcctccagcaccaccacacccagtggcccgagacccctctgagaacagtgaggctggtcctcgtgccgttccagccggtgcccggccagtggggaggacacagcctaggaaccagctgcctgagaccagggtgcctctgggctgtcctcccgcgtggcggagaccccaagcacgcagccacccatttccggagctgcaggatagagcttcctcttgatctctgtttttaagcagaaattcattgtgcagaaaagtcctccagagctctgtggccccgctcggatccgctggacccccatgcctggctgatccctgcccacgtggggcaggcccacatctaacccccacaagtcactgcctcactgcacctgccaaggctgccctggcgctgagtcctggggtccctcccggagttcctgggagaaaggcgccgtcgtggccgcctcccgcacgccaggcccgggctccaccgtgggtctcagacgccctgcggcaccggcaccgtctgctttagcatgggacccccatctgaggggtggcctggccttcggggtccccacgctcctttgcgaagtccactgtgggtgccatcatggtctccgggacctgggccagcgggaacgtgggggcactgggtgtgctgatataaagtcggcattactcaagctgc

SEQ ID NO: 1461 - DNA, 1819 bp, Homo sapiens
acaagagaacagctggttgtgatggcaggaggccctcccaacaccaaggcggagatggaaatgtccctggcagaagaactgaatcatggacgccaaggggaaaaccaagagcacctggtgatagcagaaatgatggagcttggatctcggtcccggggtgcctcccagaagaagcagaagttggaacaaaaagctgctggctctgcttcagccaaacgagtttggaatatgactgccacccgacccaagaaaatggggtcccagctgccaaagcccagaatgctgagagaatcaggccatggggatgcccatctccaggagtacgctggcaatttccaaggcatacgtttccattatgatcgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtgatcgccccagcgcggcctccgtattggagccctccctgcttccccttctttctttcctctttccccaggccgccactgcccttgcccctttcatctcccagcagccctcaggagcgtcaggatcattttcaactctggttaggcctcctacctggggaggccaggtcactgcactgggaggtcctggctgctgcgaagctggaggaggactgcgtgggctgagatgccaccctttgaagggtgaacagcatggcggcatctgggccccacagtaacacctagtggcaaccttgccttcctgacctcagcggcccttctgttccatcctctgtgggcaggggtgtggctttgttttcctccctcgtttgcttccacctcgtgcacagcgctctgcacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgtcaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacaggaatgtaagtcaacttaagaacagtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttc

SEQ ID NO: 1462 - DNA, 2004 bp, Homo sapiens
ggaagagagaatagctacagattctccatcctcagtctttgcaaggcgacagctgtgccagccgggctctggcaggctcctggcagcatggcagtgaagcttgggaccctcctgctggcccttgccctgggcctggcccagccagcctctgcccgccggaagctgctggtgtttctgctggatggttttcgctcagactacatcagtgatgaggcgctggagtcattgcctggtttcaaagagattgtgagcaggggagtaaaagtggattacttgactccagacttccctagtctctcgtatcccaattattataccctaatgactggccgccattgtgaagtccatcagatgatcgggaactacatgtgggaccccaccaccaacaagtcctttgacattggcgtcaacaaagacagcctaatgcctctctggtggaatggatcagaacctctgtgggtcactctgaccaaggccaaaaggaaggtctacatgtactactggccaggctgtgaggttgagattctgggtgtcagacccacctactgcctagaatataaaaatgtcccaacggatatcaattttgccaatgcagtcagcgatgctcttgactccttcaagagtggccgggccgacctggcagccatataccatgagcgcattgacgtggaaggccaccactacgggcctgcatctccgcagaggaaagatgccctcaaggctgtagacactgtcctgaagtacatgaccaagtggatccaggagcggggcctgcaggaccgcctgaacgtcattattttctcggatcacggaatgaccgacattttctggatggacaaagtgattgagctgaataagtacatcagcctgaatgacctgcagcaagtgaaggaccgcgggcctgttgtgagcctttggccggcccctgggaaacactctgagatatataacaaactgagcacagtggaacacatgactgtctacgagaaagaagccatcccaagcaggttctattacaagaaaggaaagtttgtctctcctttgactttagtggctgatgaaggctggttcataactgagaatcgagagatgcttccgttttggatgaacagcaccggcaggcgggaaggttggcagcgtggatggcacggctacgacaacgagctcatggacatgcggggcatcttcctggccttcggacctgatttcaaatccaacttcagagctgctcctatcaggtcggtggacgtctacaatgtcatgtgcaatgtggtgggcatcaccccgctgcccaacaacggatcctggtccagggtgatgtgcatgctgaagggccgcgccagcactgccccgcctgtctggcccagccactgtgccctggcactgattcttctcttcctgcttgcataactgatcatattgcttgtctcagaaaaaaacaccatcagcaaagtgggcctccaaagccagatgattttcattttatgtgtgaataatagcttcattaacacaatcaagaccatgcacattgtaaatacattattcttggataattctatacataaaagttcctacttgttaaaaaagatacaaaccttgtttttccagaaggtaggaaaatcctagctttccatttgtgcagttatatgtcattttctcccttcttttcacgttactcaggatgaactctctgagcagggacctgctcctgcagcaaccaaacttggagtggttattgcagacagacgtggctctgggcccctctctgtcccaccttgcacaaaggaccccctcagaccaggcccttgtctgtgccctgtccacacccaggagccatcctcagtgtctgtggccacaatcctgtactgttccttccatccctgataaaaggaggtctacatgaaagcaaaagctactgtctatttctgacccagctcatggaattttttcatcttatactgagctccagaaaggacgtaacttagcatggatcaccaatcaatc

SEQ ID NO: 1463 - DNA, 1845 bp, Homo sapiens
aaaaacacctaatgcgatttctctcttattttcagtgtatttgaatgaagcagggttcaactttgtgagaaaatgcattcaagctgtggaaacaagaggtatcaccattttaggactctaccgaataggaggagtgaactccaaagttcaaaaactcatgaataccacattttctcctaaatcccctcctgatattgatattgatattgaactgtgggacaataagacgataacaagtgggctgaaaaactacctcaggtgccttgcagaaccactgatgacttacaagttgcacaaagattttatcattgctgttaaatctgatgatcaaaactacagggtggaggctgtacatgcattggtgcacaaattgccggagaaaaacagagagatgctggacatcttaataaagcatctggtcaaagtatcactacacagccaacaaaatctcatgactgtctcaaatcttggtgtcatatttggcccaactctaatgagagcacaggaagaaactgtggctgctatgatgaatattaaatttcagaatattgtggtagaaattctgatagagcactatgaaaaggtttttcatactgctccagacccaagcattcctcttcctcagcctcagtctcgatctggatcccgaaggacacgagcaatctgcctctctacagggtctaggaagcccagagggaggtatactccatgcctggccgaacctgatagtgactcctatagcagcagcccagacagcacacctatggggagcattgagtcactctcttctcattcctctgaacaaaatagcactacaaagtcagcttcctgccagcccagggagaaatctggagggattccttggattgcaaccccgtcatcttccaatggacagaaaagccttggtctgtggacaactagtcctgaatcaagttccagagaagatgcaaccaagacagatgcagaatcagactgccagagtgttgcttcggtcactagcccaggagacatttccccacccatagacctagtcaagaaagagccttatgggctttcaggactgaaaagagcttctgcttcttctctcagatccatctctgcagctgaaggaaacaagagctacagtggatctattcaaagcttaacttctgtaggttccaaggagacacccaaagcttcaccaaacccagacctgcctccgaaaatgtgcaggagattaagactagacactgcctcaagcaatggctatcagcggcctggctcagtagtggcagcaaaagctcaactgtttgaaaatgttggttcacctaaaccagtttcttctgggcgctaacatttcctgagttatactactaagcatcagacatcgttcgtggagattttattgtgtctaggggagaagataaaaatatcagcaataataacaaaataccagatactaacaccatgcagacttgaagcaggaagatatgatagttctctgggcagctatttcagagaaggcctgaccttcagcaaagttcttgaaatttaagatgaacctgaagtacatggccatgtgaagatcaagaggaaaacatctcaggacatggacatagctggcctgagccaagccaaagccatgtactcctgtaaagcagagcacagtcatgagctttccttcccacaaggagcaatattttctaatgtgtacccatcagtggaaccaggatggttaaaggcaacttatgaaggcaaaacaggactagttccagaaaattatgttgtcttcctctaatactatttagtggatggcagtatcttcatggtatccatggtaacgaataaatgctatgattttatctg

SEQ ID NO: 1464 - DNA, 1506 bp, Homo sapiens
aaagggacacggtgtccgagtctttaggtctgcgcgggagccgaggctgcgcacctgggctgaacctccacagtcctctacactcttccaggagcagcagaaaatgaacatgtctcaggcatcagtgtcattccaggacgtgactgtggaattcacccgggaggagtggcagcacctgggccctgtcgagaggacgctgtacagagatgtgatgctggagaactacagccacctcatctcagtgggatattgcattactaaacccaaggtgatctccaagttggagaaaggagaagagccatggtctttagaagatgaattcctgaaccagaggtacccaggatattttaaagttgatcacatcaaagggatccgggaaaaacaagaaaaacctctgtggcaagaaatattcatcagtgatgctgacaaaacattgagtaaagaaggacagaaagttttagaaaaaccatttaatctggaaatagctccagagctttcagaaaaaatatcctgtaaatgtgactcacacagaatgaatttgccagttgcttctcaattaattataagtgaaagaaaatattcaagaaagaagactgaatacatgaatgtgtgtgagaaactgcagcttgatattaagcatgagaaagctcatgctgaagagaaatcttatgaacatggtgaaaatgctaaagctttcagttataagaaagatcagcattggaaatttcaaactttggaggaatcttttgaatgtgatggatctggacaaggtttatatgataagacaatttgtattacacctcagagttttctaacaggagaaaagtcctgtaaggatgatgaatttagaaaaaactttgataaaatcactttatttaaccacatgagaactgacacaagggggaaatgctctgatcttaatgaatatgggacatcctgtgacaaaaccaccgctgttgaatacaataaagttcacatggctatgacacactatgagtgtaatgaaagggggattaatttcagtaggaagtcacccctcactcaatctcagagaactattacaggatggagtgcttttgaaagcaataaatgtgaagaaaattttagccagagctcagcccatatagtacatcagaaaacacaagctggagataaatttggtgaacataatgaatgtacagatgccctctaccagaaattagactttacagcacatcagagaattcacacagaagataaattctacctttctgatgaacatgggaaatgcagaaaatccttttaccggaaagcacacctcattcagcatcagaggccccactcaggagagaaaacttaccaatatgaggaatgtgcaaaatccttttgttcaagttcacatcctattcagcatcctggaacttatgtgggattcaaactttatgaatgtaatgaatgtgggaaagctttctgtcagaattcaaacctcagtaaacatctgagaattcacaaaaaaaaaaaaaaaag

SEQ ID NO: 1465 - DNA, 1976 bp, Homo sapiens
atttgccaagaaacccccgcagcagactgcgtccgcagggcagggctgagtagcaggggcagcacctctcacaggggcagggccgcttgcccagccttgaggaagggggacccagacattgcctttctcaatactgagcccctaaacaggatttctggtctggggtctgggactaggctatctggacagtcaaactcttcccactgcgccatcagccccactaggaaagaaagaggagaaattagggctttgctttaaagagttcaacggtcagaatatgtcccccgcaaacggacatgctggaatcctcatccccaagtgagggcggggcctcacattaggaggtgatgaggtcacagaggcagaaacctcacgaacgggatcaggctcatcaaagaggcctgagagacgacacctaccagctggaaggcggttccgcaccagacaccgaagctgctgggccttcgacctcggacctccgtcttccagaactgtgagccacacattcctgatgctcctaagccacgccgtgtacggtattttgttatggtagcccaaatggaccaagataggagctaaaggtgcttgtgagattccacgcatcatactagaggtgtgagcactgcacctaagggtgcctcggatcatccctgagatgcaggcactgcaccaggaggtgtcttggatcattcctgaggtgtgagcacatcatcagaagacccttttgtccatggggtcccattctcaccttctggatacacatcactctcggggccgccattctacctgcctcatctgtgcgcggcagtctggacctagaagctctgtcccctctgctgcccagtggagtcgagtgcctggcacccaacacccagacagggtggccaccaacctggttgaggggactgtccccaagatgatcacagaacatcaggcagggctcctgagccagcgcccccccccaagcctgcctcgctcccagtacggccggaagagtagctgaggccaacccctgaagcagccaaggcgtcctctatgcccagaagtgccagggatcgggggctgcccagttccagacagggtcatcacactccgaccttcagaggggccccccgcctgccagctccagacagggccatcacactcccgatccacagagggcccccccacgcctcccagctcctgacggaagcgcctgtccagcttcaccgacctccatgccgctgcctggggtcttgctcgaacgcaagagaacacgggtctcgttgagggctcctctgccccgcatctcctgctcctggacacccaggcctgccctcaccactgctgctggacaccgggcaggggtcctggccactcttctggaaggccagtctgacgttgcaggcgcagccacttcactgtttgtccttcacggtatgccagactccctcctccctgcaagagcctctcccagggcccagtcctcccccgagaggtgctgatgagagtggagtatggaaccatctgccagccaaccccaggtggcctctcgggggtgccctgccccacagggccatgcacggtgtggccctccccggtgctgtcacgtctgaatgtggccctgcagacttgcccccactgggctggagcacatcccctggaatctgatcccaggagctccgggagcagctcgcacacagctccatggatgcccctcacagtgggagagacaggaaaggccagctccgagtctcacacctcactcttcaagctgggaaaatgatgctgttaccttgggaggtgagaccctccagatgggaacctcgacgctgggagctggtgtgttcccggaattcgggggaatatttcattccctgcgtatggtgtctggactttcagatccctcctcccaggcacccaggcatcatttcacaaccccatgctcagcaagccccagagaaaactcctcaataaactacgagtgttaatacccg

SEQ ID NO: 1466 - DNA, 1834 bp, Homo sapiens
acggaccctctggacggccggagcagacactacagtcttcaccagaggcagccccataaaaatgtcatcgtctcgggctctccccgcattacaacacaatgatttctttggggaggagaaaaaaaaaactaagatttattttgcaaccacacctccgcctcccttggaagagaaatactgaccaacaacaagttgtgaatgaaatgtctgcagatcggcccccctcgcccagcctgagaactttccagacggaaaggcgcacacgtgcacacagcaccagctgagccgatttgtgctgctctcagcagccaccggggatggaggaaccgctcaaggatctccagagtgcgagcctggttcgggacaaagttgcccaacctagtggtgtgagccacgtaaggagctggggagaggggagtctgtccccaagacaatgacagcatctagggctcagtgccaggctcccgggagaagcaaacaagccatggctttagggaggggtgcaggctcattagagagcccactgaagtgttaccaccatgcagagaggaggggtgagagggcacggctctcctctgccagtttttttctcttgggacggggaagcagtgctgcttggagaatagcaaactcaaaccttccccccaaatgccagaaatgttcccgggagtccaggccacaaggacagtgtgtgcaatggcttggaccaggccagagctgttctccctccccttaaactatgcataaaaaggaggttcccccacatgctcctcctgggatctttctggggttatcccacatgaacccgcttagattgcctttgaggaaacagagaagtgaagatcccccatccactccccattttggaaaagtggacatcaaggcccagagaagggacaggaccagcccaatgaccaacagagtcaccagtgactctggggctatgcctaggactctgtctccagtctactgttcattcccaaggacaagcccacaacacagtagcagcacctgcagatggaaagccttcgatctcaatgtcacctgtttgccgctttctgcataagtaatgtcattgttggaatgagtttatgatggtctccatccccatttctatgagctgtgagcaagacatctgctgcatagctcacgtgtgttcaggcctccctggaccagcagctctgactcacacacgcacagaacgataacgcagatgggagcatgcgcctggaaggccaccctgctgcacagcacactgactgagcaagaacaaagaccgtaaatgaagaaggatgtttgcattctgctcctcgcttgcctgaaaacaggaaactttggagacctgttctggcaaggtttccacctcttcctcaccccaaagggaactgtgtgtgttctgatggttcaatggggaaatgaggatcgatcatgagtgattttcccgaaatgcaacctgtgcaggtcttgccttcctcaagcacctgcgaggagaagtcgtcactagtggggaattccagcaggtgacccaatcgagacagctgggcaggctcctggagctgatggcttgggaaggagggagtcagaagtggcaggcccatggagggccttcaactcattggatgaagcccacccttattcccaaggataatctcctttactcaaggtcaactgattgttgatgttaatgacatccacaaaatgtcttcacagcaacgggattgcttcacagtaatgggattgctgggtcaaatggtaattatccttatgattttcttaataccattgtcttttctctaccttactttattgtagtaatacagtatatagtacctat

SEQ ID NO: 1467 - DNA, 2006 bp, Homo sapiens
ttgctgaggtgcccctgcccagccctgtccagccttgtccacacacacatctcacgcccctggtctcacagcctcacaccttgtccttccacccctgcctgcccccacccagcctgcttcttgtccagcattgatccttctgtttcaacaactcctccactgggcagagctgggcatctggcagggctggctctgtcccctgggcctttggctccagtggcccctgtgcccagcagtccagctcttggaacctcgctgaatggcagcctcttgggggcctggagctctggcagcccagccgtgtgtggtgtcaggttcctctccccaccccagcttcaagcagaggcctcggggtgggggagctacaaagcacaacaatgtacatagtgtagaaacactaacagctgggagaggggagccagctgtccagccagcatgttcctgttgtacagcccggtctccctgcgcgctctgctccttcccatgtgcagacagatcagggaggaacctccaatgggtgggggacagtgagcttcggcctggccgaggtgggtgggtgggctctcagattcagctctgtgtaaagattctctagcgggctgcgctcccaagttccccttctctgtgaaagtgaagaattagtacagctgtgttttttaaagccacctctctgtctccaccccatgggcccacacccaggtgggggaggaggaagccactgcatctgttggctcagggccccagcctgtgcaagcagggcgcctgggctgttgtgtctcctgtctgtgccgatctctattaaaggactccctcttggtgggcctggccgagtccctcctttgtgctcccagggactattttctcctcgtaagccagcgacctgcctaaagcttgggctgtgcctgcaaagcttgtgcaggacctgggggccaggtcgaccttcaagtggcttttggggccccaggttgagctctggatgtttcaagccaaggctcggctattcccgccccatagtaaatttccttttccctggaattttccaagttggcttcagctgaagagctgttttgtgaagcatcccaggcttgcccaggagagacatttgccactatgtcaccttatctgggcttgccctggggcactgagacagttgtttggcagccccagcccagccaggggctcatccttctcagctcttgtccctgggaggcctctgcttgtcacttcccagagattgcagaggtgtgtcctgcctaccatctgcctgtccagcttggtgggggtccgggtcaccatttcctccagtcctgggccccatccttgagggccttcccagccagccagcaggagaggcaagaactgggggaacacaggaacctaggggaggaggggagcgctgggcatcctcaggctggcggccaaggcctgcccctggaggcactagaggagggcatctgtctgtgggagcccagaggctgcagggaggaggaggagggaggtatctggtgtgagcgttgcccctgcgacatttgggaccacacaggtgggcttccttattccctgacaaagcctctgtttccagctcttccgccctctctggatgagggaacagaagtggaggaaacaaaagaagcagcagcacgcacagtcctgtcgctgggtgcggagacagcctggcaaagtcccactcagccatggcctgatgcaggccccaggccctcctttcttgggtgtcaaatgactgtgtcctggacatctgatgcaccacctgccctgcctgttgcaaacgtgatgctcccggatggagtggagaaactaggagactgggacaagcaaaaggctgcaaacaacccagaagcccatcctcagaagactggagaaatgattgaggaatgcatgggcaccgtggccctgtgctccatcacaaacacctctcagaaacaacgtgggatgaaaaagcaagacagttcatacagtatgatgccatttttataaagctcaaaacc

SEQ ID NO: 1468 - DNA, 2235 bp, Homo sapiens
aacagaaccagagccactcaacagcgctggaacccattcggtggggcctggggcccctcatcccaagccaggagggtttctggggaggggtgcagcccctggcagactgacagtgtggcctgggggtttgggggtgccagggaagcaggggccaacctcataggaggagacacgagtgcggttctctttcccccactggggggcctgctgtgtcagcagccaggcgggaggcctgggcggcagagccagtggtacaggggcctgggcagggcggtgtctggcagcagcggcaccatgtccaccatccagtcggagactgactgctacgacatcatcgaggtcttgggcaaggggaccttcggggaggtagccaagggctggcggcggagcacgggcgagatggtggccatcaagatcctcaagaatgacgcctaccgcaaccgcatcatcaagaacgagctgaagctgctgcactgcatgcgaggcctagaccctgaagaggcccacgtcatccgcttccttgagttcttccatgacgccctcaagttctacctggtctttgagctgctggagcaaaaccttttcgagttccagaaggagaacaacttcgcgcccctccccgcccgccacatccgtacagtcaccctgcaggtgctcacagccctggcccggctcaaggagctggctatcatccacgctgatctcaagcctgagaacatcatgctggtggaccagacccgctgccccttcagggtcaaggtgattgacttcggatccgccagcattttcagcgaggtgcgctacgtgaaggagccatacatccagtcgcgcttctaccgggcccctgagatcctgctggggctgcccttctgcgagaaggtggacgtgtggtccctgggctgcgtcatggctgagctgcacctgggctggcctctctaccccggcaacaacgagtacgaccaggtgcgctacatctgcgaaacccagggcctgcccaagccacacctgttgcacgccgcctgcaaggcccaccacttcttcaagcgcatgctgacctgggagtcacacgaacgcatcagccccagtgctgccctgcgccaccccttcgtgtccatgcagcagctgcgcagtgcccacgagaccacccactactaccagctctcgctgcgcagctaccgcctctcgctgcgagtggaggggaagccccccacgcccgtcgtggccgcagaagatgggaccccctactactgtctggctgaggagaaggaggctgcgggtatgggcagtgtggccggcagcagccccttcttccgagaggagaaggcaccaggtatgcaaagagccatcgaccagctggatgacctgagtctgcaggaggctgggcatgggctgtggggtgaggcctgcaccaatgcggtctccgacatgatggtccccctcaaggcagccatcactggccaccatgtgcccgactcgggccctgagcccatcctggccttctacagcagccgcctggcaggccgccacaaggcccgcaagccacctgcgggttccaagtccgactccaacttcagcaacctcattcggctgagccaggtctcgcctgaggatgacaggccctgccggggcagcagctgggaggaaggagagcatctcggggcctctgctgagccactggccatcctgcagcgagatgaggatgggcccaacattgacaacatgaccatggaagctgagaggccagaccctgagctcttcgaccccagcagctgtcctggagaatggctgagtgagccagactgcaccctggagagcgtcaggggcccacgggctcaggggctcccaccccgccgctcccaccagcatggtccaccccggggggccaccagcttcctccagcatgtcaccgggcaccactgatggtgattccacccctgcccatcactgggggctgcgctagctgggctggcattccctcccaacctgaactgctcctcagagccatctcctgaacccacaaattattcttacagaaagatagttatccagaaattctcattccccgtctgcggtgcggtgcgtgcctgcacacctctcctaaacacagcagggctttggagtctggcccatgctccttggccagaaggacagcaggaaagggggctgcaccccgctggccctgcgctcgcccttggccctgctgcctctgtctatttcaatatagaactgttcagc

SEQ ID NO: 1469 - DNA, 1583 bp, Homo sapiens
acaaagcaggcagacttgcccacagaacccacagccttcccctcgatttgtcctcttgctccttcctgctaggacagcagggcttctcgtacacatgctgtagcgggcactgccttggcaggagggtttggggcttccacatatcctgttctcaagattgtagcatctcagtactctagagcccagtacctgacatcaaggatgtctggagcttccttttaaggaaagaaaagatcagcaaacttgcctgttcccgtttacacttccaccaccagttcgtgagagttcctgttctgcatcctcaacactagtattaagtgagagttcctgttctgcatcctcaacgctagtattaagtgcactggcctttagtctgttaaaaagcatacaatggctacagatgttcaattggctggttatccactgatgagtccaaaggctgagctgaaactggagaagaagtcagggcgcaagccaaggagccccagggacagtgggccacagaaagaactggtgatcccagggattgtggatttcgagcggatccgccgggcattgaggaccccaaagccccaaacccctggcacctactgctttggacgcctcagtcaccactccttcttctcccggcaccacccacacccccagcacgtgacccacatccaagatctcaccgggaagcctgtctgtgtcgtcagggattttccagcccccttgcctgagtcaactgtcttttccggctgtcaaatggggatacccaccatctctgtccccattggagacccacagtctaatcggaacccccagctttcttctgaagcctggaagaaggagttgaaggagctagcttcccgggtggccttcctcaccaaggaggatgaactgaagaagaaagagaaggagcagaaggaggagcctctgcgggagcagggggcaaagtactcagcagagactgggaggctcatccccgcttccacccgggctgtcggccgccgcagatctcaccagggccagcagagtcagtcttccagcagacatgaaggagtccaggccttcctccttcaggatcaggagctgctggtcctggagctcctgtgtcagatcctggaaacagacttgctaagcgcaatccagttctggctgctctacgctccgcccaaggaaaaagacctcgctctgggactcctgcagacagcagtggctcagctccttccccagcccctagtctccatccctacagaaaagctcctaagccagcttccagaagtgcatgaacctcctcaagagaagcaagagccaccctgcagtcaatccccgaagaaaacgaagatatcaccttttacaaaaagcgaaaaaccagagtacattggagaagctcaagtcctccagatgcattcaagccagaacacagagaagaagacatcgaagccgagggcagagagctgaggggccctaacacttgcacctgccttgctcaagagcagccccaagggttcaggggtgtttctgtctccaccaccttcacagcagtacctgattccctaccgtgaaaactcttactaaataaaaccgtcttccctgag

SEQ ID NO: 1470 - DNA, 1805 bp, Homo sapiens
gcacactacgccagaacaagatggccgacgcggcggccacagctggggccggtggctccggaacgagatcgggaagtaaacagtccactaaccctgccgataactatcatctggcccggaggagaaccctgcaggtggttgtgagctccttgctgacagaggcagggtttgagagtgccgagaaagcatccgtggaaacgctgacagagatgctgcagagctacatttcagaaattgggagaagtgccaagtcttactgtgagcacacagccaggacccagcccacactgtccgatatcgtggtcacacttgttgagatgggtttcaatgtggacactctccctgcttatgcaaaacggtctcagaggatggtcatcactgctcctccggtgaccaatcagccagtgacccccaaggccctcactgcagggcaggaccgaccccacccgccgcacatccccagccattttcctgagttccctgatccccacacctacatcaaaactccgacgtaccgtgagcccgtgtcagactaccaggtcctgcgggagaaggctgcatcccagaggcgcgatgtggagcgggcacttacccgtttcatggccaagacaggcgagactcagagtcttttcaaagatgacgtcagcacatttccattgattgctgccagacctttcaccatcccctacctgacagctcttcttccgtctgaactggagatgcaacaaatggaagagcagattcctcggagcaggatgaacagacagacacagagaaccttgctcttcatatcagcatgatagagtctcgctccgtcacccaggctggagtgcagtggcaagatcttggctcactgcaacctccgcctcctgggttcaagcgattctccagcctcagcctcctgagtagctggaattacaggaggattctggagccgagaaggagaacacctctgtcctgcagcagaacccctccttgtcgggtagccggaatggggaggagaacatcatcgataacccttatctgcggccggtgaagaagcccaagatccgcaggaagaagccagatacattctagagaattgtgagactttgccctaagctgccaagtgctccccaaggagatcggtcaccaggagagcagccacaaaggtcaagaaagacacacacggaagcaaacccaggctctgtgctccttccagcccttgctggtgcagatgctaccccacaagcttgtcagatcgcccaggtgacgggccaggcgcagccatcgggaaggtcattcagccaacccagaggatgtagaccctgtcctcaagaagtgcagggcgagttctgccgtgccctctgaaatactctccctcctctcagagccctccctcgagagcctgagtgcaccatgtcttgtggcctcgcctgaagccttcctctggcttcacagaacgctctggaactctggggtctggtcagggagtgtgtcctcagcttgtctggaggaggcctgcatccctcctgagctcttggaggtgcccaggaaccctgcttctcctcacagggcctggccatatagccagctccaacccaaagccctgcacagtgcctcacccactcccttctcctggtctctcctcaaaagaattttacatgattttaaaataataatagctttcatttacatagtgcttacatttatatagcacttaactatgtgcgatgtactaatttaagtactttatattaactcatataataaatggacacaacacaaaactcaaaaggtacaaaagaataaaacagttaaaaact

SEQ ID NO: 1471 - DNA, 1687 bp, Homo sapiens
actgtacgggcctttctggacttggactccttgggagtcgtttctcggccatttgacccgtgggacttgtgggttttgtgctgctttttctttctttcttccccttttccaacttcagcaatacacccagatgttagtcgagtcacgtcccgccgccctctgcccttgaaatgctggcaagtacgcagccccgcgatcgtcacgtgacgccggggttcagcgtatccttgctgggcaaccgtcttagagaccagcactgctggctgcaccatgaatgtgatctacccactggcagtccccaaggggcgcagactctgctgtgaggtgtgcgaagccccagccgagcgggtgtgcgcggcctgcacagtcacttattactgtggggtggtacatcagaaggctgactgggacagcatccatgagaaaatatgtcagctcttgattccactgcgcacttccatgcccttctacaattcagaggaagaacggcagcatggcctgcagcagctgcagcagcggcagaagtatttgattgaattctgctacaccatagcccagaaatacctctttgaagggaaacacgaagatgctgtaccagcagctttgcagtcccttcgcttccgtgtgaagctgtatggcctgagctccgtagagcttgtgcctgcttacctgctgttggccgaggccagccttggtctgggccgaatcgttcaggctgaagaatatctattccaagcccagtggacagtcctcaaatcaactgactatagtaatgccacccactctttactgcatcggaatctgggacttctctatatagctaagaaaaactatgaagaggcccgttatcatctggccaatgatatttattttgccagttgtgcatttggaacagaggacattaggacttcaggaggctacttccacctggctaatatattctatgaccttaaaaagttggacctggcagacacattgtacaccaaggtctctgagatctggcatgcatatttgaacaatcactatcaagtcctctcacaggctcacatccaacaaatggatttactgggcaaactatttgagaatgacactggcttggatgaagcccaagaagcagaagccattcgcatcctgacttcaatcttgaacattcgagaatctacatctgacaaagccccccaaaaaaccatctttgttctgaagatcctggtcatgctttactacctgatgatgaattcttcaaaggcacaggaatatggcatgagggccctcagtctagccaaagaacaacagcttgatgtccatgagcaaagcaccattcaagagttattaagtctcatttcaactgaagaccatcccattacttagtgacccatgagctctgcatcaagggttattccaggggctactgaagatctaatatattccagccttgcacaactgctttgaggtactgtagactgctgaagtttccaccctcttcccctgggattgcacacatagctgttatttttttcttacacagcatattaagggaatataaagctttaggcatagaaatcactaaaaactgtgtttgtcatgacctttgtacttgatttatcatgactttgtatgactgagtaatatgtagtcagatcactaatatggtatttgtaattaaactacaaatagtttgtcatttccc

SEQ ID NO: 1472 - DNA, 2230 bp, Homo sapiens
agacgcagaggcgaggccgccagtcgaggacgaggaggagataacatcaagatgccgaagactgaggaaactgtgctccagaatgatcccagtgtagcagagaatggggcccctgagcctaaaacaccagggcagagccagaaaagcaagagtttctgtttagatgaccagtctcctgatctgatagagacagttaatgaagtttccaagctgagcatttcacatgaaattgtagtaaaccaagatttctatgtggaagagaccattttgcctccaaacagtgtagaaggcaggtttgcggaggcaatgtacaatgctttttggaaccatctgaaagaacagctattgagtactcctcctgacttcacttgtgcccttgaacttctaaaagatgttaaggagaatcccggagatgaataggcgagcccttgcccacaaggaacttgcatgcttgagtcaaaaggctatttcaagggaaccttaaagattccagatttgctattttatcctcacactttggagtaaaacaatctaaaaatatccttatcctttattaagaatgcctcatctccttgtggtggtgtgtatttcatatttcttatatcccacacatttaaaaccacattcttatttttattcatatttttacctcattctacctaaaaaatagtaatgactactactataactgatcccagtgaagccttgaatggtaattgtcctctagacagaaagaaataatactctctaagaaatgtagagactcagttctctgcccccccagaagacataatctgggatgcctttggcctaagagcatagttcattggagaaagtttgaggttctgaacagaacttggctcctttgatttcctttgttgggcagaccttgctatcactgctattaccatggcagaaccgcctaagaaatgagatagaagaagctctggacacagatctcctcaagcaggaagcagaacatggggccctggatgtccctcatctttctaactacattctcaatttgatggctctgctatgtgcaccggttcgagatgaagcgatacagaaactagagaccataagagatccagtgcagttactgaggggcatcctccgtgttctgggcctaatgaaaatggacatggtgaactataccatccagagctttcgaccctacctgcaggaacattccatccagtctgaacaagctaaattccaggaactccttgataaacagcccagtctcctcgattataccacaaaatggctaaccaaagcagccacagacatcactacactatgtccgagttctcctgactcacctagctcctcctgcagcatggcgtgttcacttccaagcggggcagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggagtctctgctacactttcctggaagcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaagtggtgacatggacataggataatggttatagacagtccccctcccaacgggaaaaaatgaaagcaagcaaaaagttaccagctccaagccaacttgaaatccaatcagcatttccaagttcgttctgtgagactgtagtgtcaggacaaagcaacaacaaaatgtgctctactctaaagaagtgtgggacatacagaactgaaggaggactaataacaacgaatgcaactaacacgtatttctccctcaataaacgccagatgttgtactacgtt

SEQ ID NO: 1473 - DNA, 2143 bp, Homo sapiens
cttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatgaaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcaattgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacgtaaaggtgggtagaaggtagcaagggcaggggagaagagaacaggatctggagacactccatgaagactcttctctactgcagaaattgtcatagacctaatttttaaaaaaatgaatctgaaggagtaattcaacaaatatttattgccctcaagtataatagctcagggcctgcaagcctggtaaggaggggtgtgggcagggaatggggaatagcagagcctgggaaggcagatcaccgtgttcctttatacttcccactgcctgagtcccagagtcatgggacacaaacactccagtccccactgtctctctagcctctgatatgcattctttccctgtgtatatacatgccttttcccataaaatgcaccagtctctcaccacactaattctgagtacttcagagtctcacaggtcattctgggtctagaataggctccccaactcagtgattataagtaggaagaggaaaagcaacacatggggattctgagccaggctttatgacaactaattcctgctggagagaagagtcctgatgatgggctgtctccagatcctatcttatcttcatgccattgtatgggctataacctctgcctgtaactctctctgctaatttttattttggcagttttaattaacccacaattgctgagggcaattaatacctaaaagaaagtttgattcctcttctaagatatcctaggtagtgtcatttctaaagaagacttggtgatcactgcttgtattagtccattttcacagtgctatgaagatactacctgatactgggtaatttatt

SEQ ID NO: 1474 - DNA, 2177 bp, Homo sapiens
gtgatgccaccactgctcccaggagcccacaggacctggagctctggaagctgatctcctcccactgcaccagccagcaggttcatgttcgaggccatcttcccctccacaccccaagccaggctgaagagagatccacgggaaaagccgggcctgtcctcattcaggtccacattcaggcaacaaagctcacttggtctttgcatcccatgcctcatgttacctaaggaggccagcccgtctgagaggcacagttcgatgtccagctcgatggccagggccctggtgctcctccagagcatggccagccgggacgcccggtgcccagaatggaaaccgcaccaaaagccacgcacgctcagcaagtcggtccagaccatcagccgctactacaggaagacgagtgaacccaaggatgccgccagcctcaccggcttcatgtccaaaatggaacttcgaagggtcttccccacgcatcctgactgcccccagttcagcaccagggccacatccatgtcccactgtggttcacccactgaggccgatttgtccggagagattgacaacagctcggagacctggagaggcacccaggacctgttcttggccaggcggggctcagacacgaacgtggacgggtacctccttcccttcagtaagagcatctgcgagttcgattacttgcggaagaggagaaaatcccagactttgagtccggtcaccagcagctcagtcgcatctcagagctgcctgagaaagaggatgccctggtacctctcagtcatccacgagaaggatcactgcctgtctgagctggagatacaggttcagaagaaagacgaggagatcctgctgctccaggaggagagggaggccctgaagacgcagctgaaatgccttctgaaaggcaaaggccaagagacatccatgtccccaggcaggagggagcagctctcagacgcttcgctgaagctgggcaggctgagcctcctgaaggccttctccagacatgaggaggagctgcagcactggtggcagatgcaggaggagtctgcggcaccggagaggggcaaggagcccgacctgggaggtggcgaggaggacgagggcctggaaggggagcccgatggggtggaggacacgggtgcctggggaggtgtgagccagatgggatccgtgcatgaggagggaagcgaggaggaggaagaggaggaaggggacaaggatgaggactcagaggaaagggagctgccggaggaagaggagatccccaggagaagggcctcctccctggccgagtcgtttgaggaggagctgctggcccagctggaggagtacgagcaggtcatcctggacttccagttcaacctggaggccaccaggaccagatactcccttgcaacaggagtgattgcgtctttacaacaacaagtggatttccaagaaacccagctgcgaaagatcaatacggaaaatgagacgctgcagaaggagctccgagagcggaggcagcagctacaagccatgaccgacaagttctccaacctccgagaagataagaaacaccaagagatgatggggctcattgaaaaggacaaccagctcctccgacagcaagtgtcggaactggagagaaagctcaccaagcgggactgtgtcatctcagagttggacaccaaggtcagccagctgcaggagcaggtggaactggaccagaaccacctgcagaggtggaagcagctgcaggaggatttgcagagcaagaaggagatgattcagcaggcagagcagcacacccgcgtggccctggagagctcccagtccaggctcgagaggttaaggaataagatcatccaggccacctttagcatctccgggaccaagtccttggccaacgagatctctgacaatgacatcctggaagccctgcagagaattatctcagagagaagcgactactataatcagctgaagcagaaaggcgtcaaagtgccccccctgcaacagtcagaggccttcctgaccagcaaatccaagaaggggacctccaagtaggcccagccaggcccccaaatacggtcagcccagcagaggccggggcccagctccagaaccacccgcccccaccatgcgtcctgctctcagactcagaattaaaccccggtgttggcactgtc

SEQ ID NO: 1475 - DNA, 2034 bp, Homo sapiens
agctactcggcgggatctcccggcaggatgggtaaaaagataaagaaggaagtagagcctcctcctaaggatgtgtttgacccattaatgattgaaagcaaaaaagcagcaactgtggtgttaatgcttaattctccagaagaggaaattttggctaaagcatgtgaagccatttataaatttgctttaaaaggtgaggaaaataaaacaaccctccttgaacttggagctgtggaacctttaactaagctactcacccatgaagacaaaattgtaagaagaaatgctactatgatatttggaatcctggcttctaataatgatgttaaaaaattgttaagggagttagatgtcatgaattctgtcattgcccagctcgctccagaagaagaagtagttatccatgagtttgctagtctttgtctagcaaacatgtctgcagagtacaccagtaaagtgcaaatatttgaacatgggggattagagccactcatcagactactgagtagccctgacccggatgtaaagaagaactctatggaatgcatttacaacttggtgcaggattttcagtgtcgagctaaacttcaagaactaaatgcaatacctcctatcttagatctcttgaagtcagaatatccagtgattcagttgttggctctcaaaaccttaggtgttattgcaaatgataaggagtctcgaacaatgctaagagacaatcaaggattggaccatcttattaagatcctagaaactaaggaattgaatgaccttcatatagaagcacttgcagtgatagccaattgccttgaagacatggatactatggtgcagattcagcagacagggggtcttaaaaagctcctgtcatttgcagaaaactctacaattcctgatattcagaagaatgcagcaaaagccattactaaagcagcttatgatcctgaaaatagaaaactttttcatgaacaagaggttgaaaagtgccttgtagcccttttgggttctgaaaatgatggaactaaaattgctgcttcccaagctatttcagcaatgtgtgagaattcaggcagcaaagattttttcaataatcaggggattccacagttaattcagttgctaaaaagtgacaatgaagaggtacgggaagcagcagctctagccctggcaaacctaaccacttgcaaccctgctaatgcaaacgctgctgctgaagctgatggtattgatccattaataaacctcctgtctagtaaacgagatggagccattgccaacgctgctacagtattaacaaacatggccatgcaggagcccctgcgcctgaacatacagaatcacgacatcatgcatgccatcatcagcccactgcgttctgcaaacacagtcgtgcagagcaaagctgctctcgctgtcaccgcaactgcgtgtgacgttgaagcccggactgagttaagaaattctggtggattggagcccctggtagagctgctacgctccaagaatgatgaagtgaggaagcacgccagttgggcagtgatggtctgtgctggtgacgagctgacggccaatgaattatgcaggctcggggctttagatatccttgaagaagttaacgtatcaggaactcggaaaaataaattcagtgaggcagcttataataagttgctcaataacaatctttccctgaaatacagccagactggctatttgtcatcaagtaacataattaacgatggattctatgattatggtcggataaatcccggcaccaaactgttgtctttgaaggagctctgcttacaagaaccaagtgacctacgggctgtactcttaatcaacagtaaatcttacgtttctccaccttcatctatggaagataaatcagatgttggttatggacgaagtatttcttcttcatcttccttaagaagatcaagtaaagaaaagaataatgctggatttggatctcccatagaagacaaatcagagccagcttctggacgaaatactgttctcagcaaaagcgccacc

SEQ ID NO: 1476 - DNA, 1779 bp, Homo sapiens
acagataggaaaggcggggccagggccagactggtctgggccccagtcgagggctgcaggtggtaggctgcgaccccttcctcccacagccccttcccgcccctcgccgggcatccgccgacaggtacataccaagaaattgaattgctgagtcacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggagaacgtgtcaatgacatagggttttggaaatctgaaatcattcatgagttggatgaaatgattggagagacaaatgcacttactgatgtgaagaaaagactggagcgggctttgatggagactgaagcccctcttcaggtagcccgagaatgtctatttcatcgagaaaagagaatgggaatcgacctagttcacgatgaagttgaagcacaactgctgacggaagttgatactattctgtgttgtcaagaaagaatgaagctacatttggataaggctattgcccaacttgcagccaacagagcgtcccagcatgagctggaaaaggacctgagtgacaaacagacggcttaccggatcgacgacaaatgccaccacctgcgcaacacatcagacggtgtcgcctacttccgcggagtggagagggtcgatgcaactgtctcagtgcctgagtcctgggccaaatttacagatgacaatattctccgctcccagagtgaacgggcagcttccgctaagctaagagacgacattgaaaacctcttggttgtgactgccaatgagatgtggaatcaattcaacaaagtgaacttgtctttcaccaatcgcattgctgagactgcagatgctaagaataagattcagacgcacttagcaaagaccctgcaggagattttccagactgaaatgaccatagaatccatcaagaaggccatcaaggacaagactgccttcctgaaggtggctcagaccagactggatgagcgcacaagacggccgaacattgagttgtgccgagacatggctcagctacgccttgttaacgaggtacacgaggttgacgacaccatccagaccctgcagcagcgcctgagggatgcagaggacaccctgcagtcgctggtccacatcaaagccaccctcgagtatgacctggctgtcaaagccaattccctgtacatcgaccaggaaaaatgcatgagcatgcgcaagagctaccccaacaccctccggctggtcggcttctgctagggaccccaccgggtgtggttttgatacccctaagttaaggctgagccagagcactgtctcagcatttgaaccgaatgctaatatagtcacttattaaaggattatgctgatggaaatgt

SEQ ID NO: 1477 - DNA, 2158 bp, Homo sapiens
attgggggaataaacaaaccaactaaccaactaaaataatacacttactccaactaagacaacataggaagaccagagagatgattggagtcaccaagttgaagtacattagtttgggatgataattccttatgacagtgtttatccaaatctgtcatggaaatactacatcttgacatgcccttagacttctgtctgaacattgctaaactgctgatggatcatgaaagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttagctcaccaaacaggaagacaactgacagcagaatcaatgaactggttacacaacattctgtggagacaagctgccagtagttttgaggtacaaaattacactgatgccctacaatggtactattattctctgaggttttattcaactgatgaaatggatctggacttcaccaagctgcagaggaacatggcttgctgttacctgaatttgcaacaacttgataaggccaaagaggcagtggcagaagctgaacgacatgaccctaggaacgttttcactcaattttatatattcaagattgcagtcatagagggcaactctgaaagagctttgcaggcaataattactttagagaatatattaacagatgaagagtcagaagataatgatctagttgcagagagaggttcacctaccatgcttctaagtttagctgcccagtttgctctagagaatggacaacaaattgtggcagaaaaagctttggaatatttagctcaacattcagaagaccaggaacaagttcttacagctgtaaagtgtttgcttcgttttcttcttccaaaaattgctgaaatgccggaatctgaagataaggagaaagaaatggatcgacttttgacttgcctgaatagagcctttgtgaaactttctcagccctttggtgaagaagccttaagtttggagtcaagagctaatgaagctcagtggtttcgaaaaacagcttggaacttggctgtgcaatgtgacaaagatccagtgatgatgagagagttttttatactttcttataagatgtcccagttttgtccttctgatcaagtaattctgattgcacggaaaacatgtttacttatggcagttgcagttgatctagagcaagggagaaaagcttcaacagcttttgaacagaccatgttcctgagtcgtgcacttgaggagatccagacatgcaatgacatccataatttcctgaaacaaacagggaccttctcaaatgattcatgtgagaaattgcttctgctgtacgagtttgaagttagagccaaattgaatgatccattactggaaagcttcctggaatcagtgtgggagttgcctcatttagaaactaaaacatttgaaacaattgcaataatagcaatggaaaagcctgcacactatcctttgattgctctcaaggccttgaaaaaggctttattgctctacaaaaaggaagaaccaattgatatatcacaatacagcaaatgtatgcacaacttggttaacctctcagtgccagatggggcgtcgaatgtagagctctgtcccctggaagaagtttggggctattttgaagatgctctgagccacattagccgcactaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaattt

SEQ ID NO: 1478 - DNA, 1969 bp, Homo sapiens
acttggaagcttctacctccagaagtccagacacctcccctgtacctctcgtaccacagaggacaggtctcctccagctgtgcccccactcccctaaaagccttgtattcccccctgcaggttccctctggccccaccaggagaagaagatggcctatgaaaaatcaactgatatctctgatgtctccaggtcaatgttcctgtacccatggctggaatatccagacaagaccaaagaactcagaaaagccatggctcctgttcatctgcccttgtcctgctaccagatgccaaaggaagagtttcccccaagtccagagtgctggaggcagcatccgagcaagccaaactcagtcccgtactgctacttcaagaaacctgagatctacacgcactggcacgacctgtatgatcagcgagaggaaagggaggctgagaagatgttgaggaaaatgagagatgactgtaggtacatcaaagaggtacatcaaacccacatcaaaatgttccatctcccaatgagcaagctgactataaaatctgagatgcgatccaggcccttagagcctacccaggaccccctgaagtggcaaagattaagggaactcacaaaaagcctggaatctcccagagaggatgagcagttctatgcagcacaggctctgggatgcttacgcatcagtgacaagtttgtcatggaggcactacagcaggtggcccaaactggtccagagaaagtgaagtacgaggcctaccgaaccctggccatcctgggttgcctgaataagcatgtgatccgggctctcatcaaacggctgaaggagaaaaatgagggtcaaaggatggagactttgacggggctacgaatggctcttaactcctgggctgctgtctctaaagacaagaggactcaagtcggggatgagggcaagctggtgcctgtactacagacactgatcaagaagtcgtccagtgaagcatctctggaggcagccctgtgcctgggtttcctgaggccttgcagcaacatggtccaagagttcttgttgcagtgcctgtgccaaggactcaagacccagcggatgaaggcacttaggatgctggtcaaggtgatgcacgtgcactcagccccagtcatcaaggccatcctagaccagctgtgttcttccagtgtccttgaggaccgctttgaagccacccaaatgctcaagaccattgggctggaacagatccaggcacaggggctagaggaactcacatttaacctgctcaggaggaagacgcataatgaacccttccttgctgtgaggcaggctgtggctcaaactgtggaagagctcaagttgaagcctacgatgatgaacttggtggaggcacaactgatgaacccagatgccactgcacgccaggaagcagtcatctctttgggtgtcctggggatccgcagtccacaagtgttccacttgctcctggacttactagatgcagaaaaccaccaggctgtgaagaagagtctacaagaaacattaatcctttgtgcctcaattgatccctggatccaaaacaagctgaaaaacaaggttctctttgtatatgaggcacctaagaccaatgtgaaggcagagcccacaaggttccagaaagagcctgagaacccagaagagttaactattcaagactttcgacttgcaaagctgaaccccttgtttattgcaaagtccatcaccaaagtaggccaaaagaaaacgcctgctttcccaccgtgctgctcgaaaccacgaaaacataggccacaggtcatagggccctggcagccaaggatcaagaaacagctccgggtccttgctgaaattgccaaataagtcaattctttgggcctactccccgactccctccctgaagatgcttctcaggctcccatgagaaaacaatctatacttatcttccgtgaataaacaagtgtcactct

SEQ ID NO: 1479 - DNA, 1727 bp, Homo sapiens
aaaaacctcctgaaacctaggtctggccttcagggaatctgattccttggtctggggtatggcccgggcatctcctgaagctcaccaggtcacacagaggtgtagccccagctgggaaccactgacccagactcagttcctgaatttctgtgaccgcttccatggcagcccctctcaggcccctggtgtgaggtctttcttttgcttctggcttctgagagtttcctttcctgattccaggctgggctcggttttgtctggtgggtttttttgccactgccgttgtgttagtggcatccaggtctccggattactgcatgcttgcagtgggaggaaaggcctgtctaccatgttctctgcctccccttcatgttctgtgaggagaggggccttgtctggcatgttcaccgaggcattcctgaccactagaactgtgcttggcacagagtaggcacttaataaactcctgctgcatgaacaaaagaacaagtgtggatgcttcaaaggaagacttgcacccggctgacccccagagtggggaaggggtcccacctaataggaagaacaccaagacttccccaagaggagaaggaacggctccccctttctcggcgaggccatgtgtctggaccctgtgtgagatgctttctatactagcccttgttggggtgttgcacccattttacagatcaaacaaccaagtttatcagaaattaaagactcatttaagatgccaaagctcacgagtggatggtttgatgctgaagccaacattgttaacaccatctcagctcaaaagccctgaaggccacttaattctaccaaccttcaaccatcttgtcataagacacatcctcgacccaaagcagatattctgtgtagctgatgtgtgtacagattgcaaattcaattgcggaagcatagagaggcaccagaagaggcatcttatgagagtcagccaggactgggaacatttaataagatacagaaaccagatttgcttgagctgaatgctggatcgccatggcaaccttcctttggaggttatccaagtcaggtagtgacagcaaagctgagttaaaggtcacccctgctgagaaagatgggcattgataaaggattttaacaagacccagaggagctggtatttggaagctacctacagaggatcgacgaggccctaggaatgggtggcaaacaacatcaggaagaggggggcatcctgcaggggctcccaccagagccccgacctcgcccttcagatcgggagctccagccttcaccagaagctgagattggagctgttcgtaattgttcaatggaagggggaacaaccattttaaccaggcatccagatgggaaagaaatacacttatgccactctacacccaagacacgcattcctgaaaagttctgaacaagccaaatgcttgcaaatggaacgggcttgaccttctttatcactccagaaatgctttatttaatcttttttctattggagcatcactttaaaacctcaaagttgagaaggcttttctttgcatgatgctgaagccagaagccttcaaggaaacaacataaatataaatatctctgtggccagtctctacaaaaatacataaaaatgaattttaagcataataaaatgtgaaaaattgcccaactttcctcacaaatgagtaaaagccaatttaaatgataagaaatgaataaatgcatattaaagc

SEQ ID NO: 1480 - DNA, 1839 bp, Homo sapiens
acataatctcggaccggaggagcggtggcacatggcggcggaacggcgctgtggaagtatgcgagacttaagagctcaagtgactagtggtctcctgccatttccagaagtgactcttcaagcccttggagaagacgaaataacattagaatctgtgcttcgtggaaagtttgctgcggggaaaaatggacttgcttgcttggcttgtggtccacaacttgaggtagtaaactctataacaggagagcgattgtctgcttacagattcagtggagtcaatgaacagcctcctgtagttttagctgtgaaagaattctcttggcagaagagaactggattattaataggattggaagaaacagaagggagtgttctctgtctttatgaccttggaatatcaaaagtagttaaagcagttgttcttcctggaagggtaacagctattgaacctataattaatcatggaggagccagtgcaagcactcagcatttacatccaagtctgcgatggctttttggagtggcagctgtggtcactgatgttggacagatccttcttattgacctatgtttggatgacttgtcatgcaatcaaaatgaagttgaagcatcagatcttgaagttctaactggtatcccagctgaagtaccacacattagagaaagtgtgatgagagaagggcgccatctgtgtttccagttagtaagtccaacaggaacagccgtttcaactcttagttacataagcaggacaaatcagcttgctgcaggtttttctgatggctatctagcactttggaacatgaaaagcatgaaaagagaatattacatacaattggaaagtggacaagttcctgtatatgctgtcacttttcaagaacctgagaatgatcgtcggaattgctgctacttgtgggctgttcagtctacacaagatagtgaaggggatgttttgagtttgcatctactgcagctggcctttggtaatagaaagtgtttggcatcaggacaaatcttatatgagtggttagaatactgtgaagaaagatacactctggacctgacaggtggcatgttccctttgaggggacagacgagtaataccaaattgttgggatgccagagtatagagaaatttcgatctcatggtgacagggaggaaggcgtgaatgaagctctatcgcctgacactagtgtttcagtctttacctggcaggtgaatatatatggacagggaaagccttctgtatatttggggctttttgatataaatcgttggtatcatgcacaaatgccagattcgttaaggtcaggagaatatctacataattgctcttattttgcactgtggtcattggagtctgttgtaagtaggacttctccacatggcatcttggatatattagtacatgagagaagtttaaatagaggagtccctccttcatatccacctcccgagcagttttttaacccaagcacttataattttgatgccacttgtttgttaaactcgggagttgttcatttaacttgtactggctttcagaaggagactttgacttttttaaagaaatcaggtccatcactcaatgaactcattcctggtggttataatcgacgtcttgtagctggccttctttccccaagttttgttgatgttcagccttccagtttaagccaagaagaacagttagaagctatattgtcaacagcaattcagactagttccctgggacttttgactggttatatccgaagatggataacagaagaacaaccaaattctgccactaatttgcgctttgttcttgaatggacgtggaataaagtggttctcac

SEQ ID NO: 1481 - DNA, 2818 bp, Homo sapiens
gttacctggtacgctggctgctacctccctcactcttgtcagagtcggagctacaggcagtgccttcagctctgagctcaggcatcccggtccctgtttttgcggttaaggactctaaagtgttgtgtcgtgttcatcaactttttctcaacttccctggctctacctcttctgccacaaacgtcagcatggtggtatctgccgaccctttgtccagcgagagggcagagatgaacatcctagaaatcaaccaggaattgcgctcgcagctggcagagagcaatcagcagttccgagacctcaaagagaaattccttataactcaagctactgcctactccctggccaaccagctgaagaaatacaagtgtgaagagtacaggaatcacctgcccccagagaggtgcagaagactgaagaaaaggaagtccctcaggactcactggaggaatgtgctgtcacttgttcaaatagtcacaacccttctaactccaaccagcctcacaggagcaccaaaatcacatttaaggaacacgaagtcgactctgctctggttgtagagagtgaacaccctcatgatgaagaggaggaagctctaaacattcccccagaaaatcaaaatgaccatgaggaggaggaggggaaagcgccagtgccccccagacaccatgacaagtccaactcttaccggcatcgtgaagtctctttcttggcattggatgaacagaaagtttgctccgctcaggatgttgccagggattactccaatcccaaatgggatgaaacctcacttggcttcctcgaaaagcaaagtgatcttgaagaggtgaaaggacaagaaacagttgctcccaggctcagcaggggaccgctgagagtggacaagcatgaaatcccccaggagtcactggatggatgttgcttgactccttccatccttcctgacctgactccctcctaccacccttattggagcactttgtactcttttgaagacaagcaagtcagcttggctcttgtagacaaaattaaaaaggatcaagaggagatagaagaccaaagcccaccatgccccaggctcagccaggagctgccagaggtgaaggagcaggaagtcccagaggactctgtgaatgaagtttacttgactccctcagttcaccatgacgtgtctgactgccaccagccttatagcagcaccttgtcctcattggaggatcagcttgcctgctctgctctggatgtagcctcccccaccgaggcggcctgtccccaagggacttggagtggagacttgagccaccaccagtcagaggtgcaagtttcacaggcacagctggaaccaagcaccctggtgcccagttgtctgcgactacagctggatcaagggttccactgtgggaacggcttggcccagcggggcctttcctccaccacctgcagcttctcagccaatgctgattctgggaaccaatggcccttccaagagctggttttagagccctctctggggatgaagaaccctccccagctggaagatgatgcacttgaaggctcagcaagcaacacacaagggcgtcaagtcactggccggattcgtgcctcccttgtcctgatactgaagaccatcagaagaagactcccgttcagcaagtggagactggcattcagattcgctggcccgcatgctgagagcgcagagataccaaatactgctggaaggacgcaaaggatggcaggatgaaagaatgtcacaaaaagcagcttttccacttgataaaaacaactaaaacagcaaagcaagtttaagtccaaacacaatactgcaggggtccttcactgaggattgaatttcagacacagaatactcttgatgacttcaagccactatgctcctttgatttgagaagccacattccatccccctccaattgtgatcaatacctagggagaccaatgcccagatggacaaatagcattgaccggcgttagccctgtttctcaattcccatcgtgtagagaacaggagtccgcagctgctggcaggagacagcatgtcagccgggactctgccagggcagagtatgagcaataccatgttcttgctgaaaacgcttagcctgagtttcataggcggtaaccctcagataactgcagaatgtagaacattgaacaggacaactgacatggacttgtttgtggaggacaggtcagctgtctggctcaatggtctacattctgaagttatctgaaaatgtcgtcatgattaaattcagcctaaacattttgccaggaactctgcagagtccatgctgtgagcttcctacctcagcccatctgcaggcagagaaggcccagtgtgtccatccccagtgcggtgatactaggatggtcacttggttaaggaggggtctaggagctctgtcccttgtaaagacatcttatttgtaagtaatttggaaagtggtttgaaatagtataaatatcctgtattctagtgatcttcttcagaacattttatcaccaattaatcaccccgtctgtgtcagttattatatttaagtttgtacattgaaaattgtctatctcaaaatcttaccttatacttgcttttgctggcattctttgtaaaaaagatcattccctgcccaaattttaactttcatccaaaattaattttaatttctttttgctggcattctgttgtgaaaaagaatattctctgccccaattataactttcatccaaaattaattttagtccatcagttaaaattttaaattttaaatctgtttaattaaaacatttcttgcctctc

SEQ ID NO: 1482 - DNA, 2033 bp, Homo sapiens
aaatagaagattgtggatccctgggaacgcagagcaggaatgcgtggcaggaaggaatctcccagggattcacagttcacccctaaatcaatccgtggggcccgaggggcaaagtatctgagtgacccagccctcagtcttgtgtccgttcctgagaaggagctcagccttgcccctcaggagctgcatgtaccaaataccacagatggaggcgtgacacagactgtccactgcagagaccatggacggaggcagcctccgagccagcccagcagccatggacggaggagccttggagccagcccagcagctctcctcactggaggggtggacgggacaggaccggctgctcattccacgctggagggaggccaggagtctcagctggatgcagtcacctgacctggagagttcaaagtgcctaacacagggacgctgctacccacaagcctggatcctggcgtgctccgcggctctccttcaagccctggcctcatcagacctccaaggctccctagacagggttaattattcacgtggcctgggacccagggttcgtttgtttgtctttcccgacacagtagggtccacgaggaagtcaggatccaccggcaatatttgcagtgttatgttgaatgtggcaactggctgcgtgaggatagagaagtaaacagcatgtccggtggcagtcggttaccacacagaatttaggaggcccagtgaaatgcaaatgctaggtaagtgacacgtaagtttttgatataagcataccccaggcaacatttatttattggaaattgaaactcacatttaaccggccatattatttttttttaatttttttgttctctaaatctatcttttgtttgccgaatttctagcaaccttagatggagaggtggctctgagattagcatccccacaggcccacctctggctggagagacaaagggaggtggggtgctgccggggagggagagccaaggtctacttccacgccgctcccagacctggggccagaggcccgcttgctgggggctggggctcagaggggagcgagcggctgctgtcaggctgtctgaaaatgctgtgcggattccccgattttctctcgcctggcaggtcacctggcccacactctcctcccctgatcccctgagtgctcccctccccctgcaggtccccctcccctctgggtgagcctggatgccagcaccctgttccgcccgcccagcatgcagaacaaaagcacaacgcacagaaacacagccggtgcgcgcagggcggcaggctggcttctccctccctcctgccgaggtctccggccccttcccccttccctccttccctcccctctcctcttctattagaaaatgggagtgttagggttgaattgtgtccccccaaaacaggtatgttggggtcctgattcccagtcccctagaatgtgaccgtgcttggagataagacctttacagagtaactgattaaaatgaggtcattagcagggaccctagtgcagcatgactggtgtcctttcaaaaaggagaaatttggatacagacatagacacacactgagggaaggtgaagtaaaggggcaaggagaagacggcctgcaacgggagtgacgcccttacaagccgagggacgcctggcagtgccagctgacaccaggagcagggagaggccaggaagcctggcagtgccagctgacaccaggagcagggagaggcctggaacggttctccctggagacatccgggacacaccttgatttcaggattccatgatagcttccagaactgccaaagaacgcatttctgtgttttcagccacccagtctgtggtatcttgtgactgccgccctaggaaagtaaaacaaggagttaattcatgaagggtgggggaaatacgtaccctttgaaataccacctagaggaaggggtaatagtacacccgatcatgtgctccagtttatgaaatagttgcacgtcactcggaattttgaaaaacaatatattttcaggactc

SEQ ID NO: 1483 - DNA, 1886 bp, Homo sapiens
aacggtgcccgagggactcgcgctgcccgttaagcagctttgcggtggcggaggctgggctgccgtctctccgacatcccgggacggaggaagagatgaaggctctgcagcccccgccgcccgatttacgcttgagaaagcgaaggcgagagaggtcgtccagcccctgggggcccagccctagagagcggggcgcgggctgcggggcccggcggcctggacggcggagcgttgaaagctcccccagggataggaagtgcagccgaaatcaacgattgagggtctgagcacctccctcatgcagacagagccccggctcccatgttcaccatgctgagaaagacctgcgggggacagcaggaggacagccggggaatgggcccgcacttgcccagaggcagagctcgtgcatgcccgacctcgctcctcacggctccctgggcagcagcgccctggcagttggaactggaaggcttatcagagtccacgcagccccaccgccctccccactctcgggggtgggcatcgggggacagggccagggcagggaggaagacagggcccggctcaccccacagctcagcccatgagggtgcgcagagcagggctggcaggagtgggccactccacacccagccctgttgaagagaaagaacagaaatagggaacagaaagttgtcgattgctgtgtaacaaattgcccgcagtttagtgccttcaaacaaacgtagctgcacagtgtctgtgggtcagacatccaggcccggggaaggagcctctgcctcaaggtccctcccgaggcctcagtcagggcccggccggactgtgagtagattgcacgctccgtgcggggaggctcggcttctctgctggccccgcgcctgtgggcaggattcagttcctcatgggctattagagtgagggcctcgatcttttctgctgtttggctggaggcctcgctcagttctctgctgcacggacctttccttggcacagctcccgcatagctgagcaagccgcgaaggcgggctcctgcagccgaagggaattctcccgtttctgctgtgttctgtttgtgtaggttcagccccggggaggaggttccacaggacagacagaccaggagttgggggcgttgagggccatctcacaggctgcccaccacagcccccacgcagccacctgtgtctgtgttcttgccactgtccctaccctccaggagtgggtctggtctcatcagggagggcagcgctctcttcactctgtccttactctggtgtttcactgtgattttaaaaactgaaactgcacttgttaccccttgacagagctgcaccctgagagggcctctgcgacgcccctccttctcttaagcctttccaagctgtctgacgatttttaaatcccatttcctgagtgacacagagcatcttttcttaagcttatgagtgacttatttgtgttttcctcaaagctagaggggacccccaatctgtttgtttccagagtccctgatggtgtcgtcttgggagtggaggaacctgagggaaaagcccagggacgagtcaggggagagctctgccctggtgctcttgcacgtatccacatgggccacagctgcacccggctctcagcagagggcatcgccatgctcctgggcacagccgggccctctcgcctccctgcggctcctgatgcctcccaggctccgctgaggtcaccttgggcacttagcgtggctgcagctctttgcagccccgtgtcctgtcatccatgtggccgtcatgtggtcacttttgggcactgccctgcgcaaggtccatggggactgggcacctttggccattctttctttggttgtctgtgcaagtaataaactaaatctg

SEQ ID NO: 1484 - DNA, 1776 bp, Homo sapiens
actttgctggcagcagatcttcgcggagagaagcacggggagggtgacatgtggtacagagcaggaacgatggctctgtgcgatagcagcagacaaaggttgccatggcaagcctgctcaggagcatgccacatagaccgatgcccacaagtccacctggctccaagccacagacaaggtcccttgtgcataggtaccgtgtccccaccccgggatcccaccacagccaggaccccttcccgaggtgcatccggaccctcacccaggagaagccgatgcagccaatggccccgcacagcatgtccgcaagcatggccgggtacgagctggcagtggggaagtaggcgaagaagtaggggctgtgccagtgcgtcacctgcatgggaggacagagcagctgctgaggagtgaggaaagccaggcctcaagagagcgggggacccaggtacccccatggctcccagctgccagatgcagccagacccagagttaggtctggctcagaatcccagcagcagaggatatgctctatcgggcttggctgctctgctctgaatggaggaaggagccgacaaagacaaagcgcccggggcccaggagagtttaagagcagccctgtggctgactagcccctccgcacctggagggcccatgtgcctttgtctctctccccttcctgtggcctctgggctggaaaaggacagaagcgattcttgattagggacagatgtgtgctcttttgcttcactctccgctgatattcacagcaacttttgagatggctgggcctgcacttgctccgctcacggctcgagagctcacctggtttcctgcgatcacacagccagcagttcgtgggctgcagctcccacccagggaccttgcccaacgcctgtgcatttcccagctcagctctgcgcagtgaatgcccccatagaaggaagcagaaagacttcaaatcctcccttactctcctgtactccccactgcctgacatttagccacacctctcccaaagggttttatgctgaacagcttagtgtacttgcacaatttctagaagaacctgaatcctgttctttgctcaaagcataaatgccaagtgagaatcccctggaagaagaaatgtgagcagtgtggtgagagaggcactcagctactgagaaaccagtccctgaggtccggggcctgaggcctagtctcaacccatgatcagtggactgtaaccttgtctgaccttatgccttcacagggccttggcattctgtctacattgagggagtgggtcttgatggtcccagacccctcttctatgaaaatcacatgtcgttgctcataggccttacaaccacagacatgctgggtcgcagcagtgatcaaccagtggagcccacggagattttccctgcctggactctgcacattgttgcatggaagggcaggtttggccatcctcataaacattcgtgatctagaaactggccgggctgcaactcccacccagaccctgactaggccagagccactttaactaacaggcttttaggtgaactccttggcagagaaaatctactgtggaagcgtaaagctgaagggaagtttctctgagctccaactctgctgccctgtgagtgagtatcggagacagcagccagtcccgctgatttctgccctctgtgtaccccaggcctactggcttcagagaaaaagggctgccttggtgggcagcaccacactgcccactctcaaataaactaaagaaaacgtttcttccac

SEQ ID NO: 1485 - DNA, 2123 bp, Homo sapiens
gctgcggccccgccccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcagccccagcttggtgaccgggtggctccattcaccctgggtccctcgctgaaacggtgcctgggaccagagcagagaacacgcttgccagtggtaggagatggaggcgacgtggactctgggaggcttcttttttggggtccatccagaggccgagcctctccaagcactggtcagcctccatgccacccagtctgccgaccctcctctccaccatcccctcgtccgagcagtggcgatccctcccgagtcaaggctgggcacaagcacgtggggacaggccgggcgaacctcttcccggccgctctggtgcacttgggagccgaggagccggcaggtgtctacctggagcctggcctgctggagcatgccatctccccatctgcggccgacgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctc

SEQ ID NO: 1486 - DNA, 2857 bp, Homo sapiens
gagagaggcgatgcttgaagttcattggtctttgtgagacaggatccatggaacccagtgacatgcctgctggctaccactgccccttagactctgccccctgggatgagaccagagacccccagagcacagagctgatccccaggagagccatcagccgctctccaacctgcgcccgctgccgcaaccatggtgtcaccgcccatctcaagggccacaagcgcctctgcctcttccaggcttgcgagtgtcacaaatgtgtccacatcctggagcgccgcagggtcatggctgcccaggtggccttgcgtaggcagcaggaggcgcagctaaagaagcacctgatgaggagaggggaagcctctcccaaagctcccaaccacttcagaaagggaaccactcagccacaggtcccctctggaaaggagaacatagcaccccagcctcagaccccccatggggcagtcctgctggcaccgacaccccccgggaagccttgtacccaactccagcctgtgccctctgcccctgcagaactcctgtgggcctctgctgctcagccatcccccggaagcctcgcccttgtcctggactccggtgcctcctggcccttgggtccctggacactggctgcctccaggcttctccatgccaccaccagtggtgtgccgcctgctgtaccaagaacctgctgtctctctgcctcccttccctggctttgaccctggcacctccctccagctgcccactcatgggcccttcaccacctgcccaggatctcacccagtgctgacagctcctctttctggagagccccaagggccccctagccagccccgcacacactcaactctgatactccagccctgtggcaccccagaccctcttcagctacagccacaggtcctgggaaagaagtgggatctagggccctgggaggaggttgagcctggggaaggaaaaagcaggaaactgaaggaagcaggggctgaggaacacttagagggtgggcagaagcgggggttcccagtctgcttgtctccctttcccttgcaggcctctggagcctcgtgcctggcccggacatctggcccctcagagtggcagctgcagcaagaggcagctgaagccctcgtggggctgaaagattcatcccaggctcctcgtgtgaccccttctgtgccccccaaccctgcctggatctccctgcttcacccctgtggcccaccaggtgggccatgaaaggggaggatggatagggatggctgggaaatggagatcactgaagtacacagggactaaccaaggagatgagggggtcgacaggttgaacgtcttcaggcccaggaccccaagctcctcagcctggcccctgggattgcagttgagagttattcagtgaatcctttttatcagtttggcactcgacagcaaatttcttgatatcaaggaaagtggggcactgagaaaggcagggacttgcccaagggcatatagtgagacagtggcagggaacccaatgctctgtctctggacccaggctgcctgctgaagtctgaagtggggtctggcctgggaggaggtctgataagtgccttcaaggagcttacgttctagttagggaaattggatgccttcacaaggctcagtgacaaacctgaagaagattggaggaaccttgaagagtgagaaacacctagggggacagacagggaaagctgcgaattctcttgtccaaatagtggattgggcagactggcctggaggaaatgctagagcagagggaaaggaggctggagaggcttctgatggtggagatctggcatgccaggcttaggtgtctagaacagcaactgtatgtgaaggggagccagggaacgtttctgaactaagcaaggacaaattcagagaccctgagctttagaaagacaagtgggtggctttgatggacggtttggaggaggcaagactggaggtgggaaaattagcaaggaggtctgtgaaataatccaggagaacaatgatgaggcctggattggattcggtaaaaagagggggttgctagaaggaaaaacaggtgtgacctgatcctgccccttccttcttgcctgtagctcctgctggaggaagaggattccagcctgttggcccctgtcttcgacccagcccagccccctctgttgctctgcatattggccgtctggggtccatctccctcctgagctagaaacccagagatggaggctgtcttgctatggcagggaggtgacagcctgctggcactgtatatttagtgtcttacttaaggatttatgcatggaatttaatgtagtacaagcttcgggcttttttgtttgtttgtttgtttgtttgtttaagctttcaggtgcttcattagctttcagttcctttggtagtgtgggcatttccttggctgacagtggatattcttgtacccttcttgggtcctgggatctcttgaaatccccaataaagagagagttgtgctatttaagctgaccagtatctataaacgtgtttgcatgagtttacatcccaggattccatgattctgtaaatgcctatgcattcatgtctgtctccatgcatgtgaaaacaggagagtgttttcattttgtgtctaggtttgtgtgagtaagcaagaaataaacctttgttgttgtaagccactgagatttggagagtgttaccacagcctaacctagtctatcctgactgacagaaaggacttgttcatttcgcttctcaaagtgaaaaatctgttatccaatagctaccatagatgaaaacaaacttggatttttttctttgtccaaataaaaaaaatgatgtaaag

SEQ ID NO: 1487 - DNA, 2107 bp, Homo sapiens
aggtttgtaaatgattgcctggcagccaccttggaaacttggctccctcaagttctcctcttgactgcattcttgaggaagcagaagagacagacgcaagctgtggagctgagtcgggttcagacaagccctgctgaaatacagggagaatttagaatccccaacactaaccctgtggtgatttgctgtaaactctgtcagcgcttgcactttggtcaagaaaactcaggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagcaccctggatgtagaccgcgtggcccgggaactggatgtggccactctgcaggagaatattgctggcatcaccttctgcaacttggaccgggaggtgtgcagccgctgtgggcagcctgtggacccggcactgctcaaggtgctgcgcctggcgcagctcatcattgagtacctgctgcactgccaggattgcctgagtgccagtgttgcccagctggaggcacggctgcagaccagcctgggccagcagcagcgtggtcagcaggagctgggacgccaggctgacgagctcaagggtgtgcgggaggagagccgccggcgtcgcaagatgatcagcaccctgcagcagctgctaacgcagacaggcacccacagctaccacacgtgccacctgtgtgacaagacattcatgaatgccacctttctccggggccacatccagcgcaggcatgcaggcgtggcagaaggtggaaaacagaagaaacaggaacagccagtggaagaggtgttagaagagctacgggccaagctaaagtggacccaaggggagctggaagcccagagggaggcggagaggcagcggcagctccaggaagcagagctcattcatcagagggaaatagaagctaagaaagaatttgataaatggaaagagcaagagtggaccaaactttatggggaaatagataaactaaaaaaattattttgggatgaatttaaaaatgtcgccaagcagaactctacactagaagagaaactgcgggcactgcagtcccacagtgtgatggagtccaagctgggatcactgcgagatgaggagtcagaggagtggcttcggcaggcatgggagcttcaggccctgagagagaagacagaaattcagaaaacggagtggaaaagaaaagtgaaggaactgcatgaagagcacatggctgagaagaaagagctacaggaggagaaccagaggctccaggcctccctgtctcaggatcagaagaaggcagctgcccagtcccagtgccagatcaacaccctccgtgcccagctgcaggaacaagctaggatcattgcctcccaggaggagatgatccagtccttgtctctcaggaaggtggaagggatccacaaggtgccaaaggctgtggacacagaggaggactctccagaggaagagatggaggactcccaggatgaacagcacaaggtgctggcagctctgaggcgtaaccccactttgctgaagcacttcagaccaatcctggaggacaccctggaagagaagcttgaaagcatggggataaggaaggatgcaaagggaatctcgattcagactctcagacacctggaatccctgctgagagtccagcgggagcagaaggcccggaagttttctgaatttctgagtctgaggggaaagcttgtcaaggaagtcaccagcagagcgaaggagagacaggagaatggcgctgtggtgtcccagccagacgggcagccttcaggctgaagaggaggaggaagaggaggggttgctcttgctgtctcccgggtggcagagtcggaagaaaatccatgtataagtggacccatggctgttcaaccccacgttgtttcggggtcaactgtatttcaaacattttctgatcttgaattactgtaagaaactcattttacattgtgaccc

SEQ ID NO: 1488 - DNA, 1927 bp, Homo sapiens
agacttctgctggcagttactgagagagataggctttccatccatggcagccatttacttttgctctgggagacgtttgtaatagaaaaggcacaactggggtatttattcatttccccccgttcctctagtgtttggtggcgttgccgttgcaagtgcgcagggctaaaatgaactggttatcttaggatcatggaaaacctggaatcaaggctcaagaatgccccctattttcgttgtgagaagggaaccgattccatccctctatgccggaagtgtgagacgcgtgtcttagcctggaagatcttctctaccaaagagtggttctgcaggatcaatgacatatcacagaggaggttactagttggcattctgaagcagttaaatagcttatatttgttacactatttccaaaatatccttcagaccacacagggaaaggatttcatctataacaggtcccggatcgacctcagcaagaaagaggggaaagttgtgaagtcctccttgaaccaaatgttggataaaacagtagaacagaagatgaaagagatcttgtattggtttgcgaacagcacccagtggaccaaggcgaattatactctcttactgctgcagatgtgcaaccccaaattactgctcactgctgccaatgtgatcagagtcctgtttctgagagaggagaacaatatctcagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttccttggggcagcatctaaccctgaggaaccatggaggaattcactccggtgtatatccgaaatgaataggctgttttctggaaaaggagacataaccaagccagggtacgatccctgcaatctattggttgacgtggatgacatcagagacctgtcttctgggttcagcaaataccgagacttcatccgttacctgcccatccacctctccaagtacattctaagaatgctggatagacacaccctgaacaagtgcgcctctgtgagccagcactgggccgccatggctcaacaggtcaagatggacttgtcagcgcacggcttcattcagaaccagattaccttcttgcaggggtcctatacaagagaaatgttttctgtgggacctacaatgttcgcattctctctgacacgtgggatcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaaggaagcactgatggcctggtcatggcctggagcatggtggggaagtacgagcgctgcctgatggccttcaagcatcccaaagaggtgctcgacgtgtcccttctcttcctccgggtcatcagcgcctgtgcagatggcaagatccgaatttacaatttcctcaatgggaactgtatgaaggtgataaaagccaatggcagaggc

SEQ ID NO: 1489 - DNA, 1648 bp, Homo sapiens
cctgacctcaagtgagctgactgccttggcctcccagagtgctgggattagtcgtcatcttttgttaaaccaggatttgatttttttcttttcttttcttttcttttctttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacgggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcttgggggatgatacagtagcactttacaaatggctccatgtcattcatcccaggggccataatctcttgcaccacctattcttacttcctgttcagctcctttacagcttttattttcaactgcttcccaacttggtggggcctcctttaaggatgagccaatagtaagaatgtggctgtaatcagcagagacccctctgaggggtatctgttctgcagcccctagtgaaatcatgtgatgtgagacagaaacctaaacatggtacttgattctaaacctgtgccagtctatagcctctgcctccccaagcagagctcaagccaaacgcttctgtcctctttccttctgcattaaccctttgctgatcctcaggggccactcccccaacacccctgtacttgggtgagggatgttggacagagcctgttttcatgtactgcaggtggtggtgtgctgacatgtttgctcttggttgatggagaaggtacagaggccagggagtgaaaatggttgacagaagagggaagagttaggtgtctcatagtcactcatagtggggtggtcaggggtaatggcatctccccactttaggcttctcaaacagacttttgacacctctcaagttcagagctctgatgtggaaagacaggaggtgtggggaaggagggggatttcgtgtgtttgcatgagtgtgcgcttcaggccttgggagttggcaagagggagggaaggaaggagagcaaaatcttcggaaggtgtttcttgtacctgagggatcctgccctgaatctccatagtctccactgtgaactgaggaggggaggggtgtgctggggaataaatcttgtatgagaacaat

SEQ ID NO: 1490 - DNA, 2444 bp, Homo sapiens
aacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaagacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcgttcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttaaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagag

SEQ ID NO: 1491 - DNA, 2137 bp, Homo sapiens
gtgtgcctcagttttcttatccataaagtgcatatgctcagaccacctacttcatagggttgcaataaggataaaacgcaatagcaacagctgacacttactgagcattttacataaattaacgcatttaatcccacaacaacgcaatgaggcagccctcgttttacaggtgagaaaactgaggcacaaggaggttaagtaacttgtgcaagatcaaatgacaaataactggagatgctgagatttaaacccgggtgctctgacccccagaacctaccccgtcagcagtacatacagtgtccagcacacaggaagccccaaacatatgcttgggtgtatccaaaagtccctgtctgtgctctgggagagctcattcctctacccgccactgcattccacagcctgtagaagtcctcaagcgccccgtgatttctgctagttccagagtggggtgtggaggaaaaggtgctttcattaggcctgttttatgaggatgagatgaggaacccagggctcacagatgaaccatgctttgcccaagggcatgaagcctttaaaggcctgaaatgatttcacactcccacacgccacggctctgcacagggcctagatgactctgattgtgagtgaagtttctgggagaacagagaagcatgttggtgagaaggggaggcacttcaggggatggcagagctgggagcaagatggacagaggggcctagctggctagccactgtccaagcctgggtctgtgtctctggtgtgtgtgtgtgtgtcctcatgtggctgtggacaagcaccagggaggtgggaagccagcattgagcagcacaggtcaagaactaaactcccacctcctgattcaggcagctcagagagctggctgctgtcatacagggtgtctaagcgcctgcatccatcagccagccgtcatcacagcccacccccaggtcacaaatcagcagctccactcacctcctgccagcaagcactcccaggccagctctgtcactggtcgctgagcttttggaaaatgcaaccctgtcagccctcactctgaggcgagacggctcacgttccagcgtgtgcatgagcatgccagcacatgatgcatgcacaggttgtacccacagacatgttcacacctgtgggcacaatgcagacatgttcacagcgatacacacagagcatatccctgcaggtctgcaaatgtggacacatgccagcatgctatgcgtgcacgggaggcaagctctcatgtgtgcactcatgtttgtattcagagcatgcacatgcctgccatagataagttctcttacatgcatgtacatgtgtgtccactggtactcttcaataagcaaacatattttcccattcaggcatatattcatacccattcactaacatatgtgtgtccccagaaactcccactcaaatacatagcacatatgtgtgcataccctcaaatgtacttctgtgcatgaacatacaaccccatgctctcattctcagtcatatgcccatttgtatgcacgcacaggaaagcaaatgtaacctcaggaacagtccattacaaactccaaattcaaacgcatgctcccatagatgcatttgtacatgtgaggacataggtctgtgtgtacgaacataatatacacgatcaagtacaagcacctaaacaaacagccatcctccaacaaatgctcagatctgcaccaagcactcacacacatgcaatggtatatgtgcatctgcctgtctccatgtaggttcctcaacttccagacaacgtgtcctcaggcattaaccacctctgtccacgtgcacctttaggcaggcccagcacagttcactcatacccatgccccatgtgcctaactcaaccccacagacaagcacgcacatagacacgtgcctccaaagcccatctcccacacgtgtgtggagtcagatccctatcatgtggatgcacacacaccctctctggggcacagcctgcccaaccccagatagtcaggtgtgctggggacagcaagaatgatgcccacacgcagaaatcgccagtcacgcagaattgcatctgctgcaaacttctcatctgctgtgcaaatgatgattaaatgttattgtgcaagag

SEQ ID NO: 1492 - DNA, 1979 bp, Homo sapiens
ttgtgaggaaagtgggtgcgacctttcaaaggacgtgaaatgtgagcagagggagggggtgtgaccttacaagggaagtgggtgtggcctttcaaagaaagtgggagtgggatgatttcatggaacttggcagaagtatccctgacacccaactggagcaggtcatcgagagccagaaggcgaatcaatgcgcagtgctcatctacacttcagggaccacaggcatacccaagggagtgatgctcagtcatgacaacatcacgtggattgcaggagcagtgacaaaggactttaaactgacagacaagcatgagacggtggttagctacctcccactcagccatattgcagcacagatgatggacatctgggtacccataaagattggggcgctcacatactttgctcaagcagatgctctcaagggcaccttggtaagtactctaaaggaggtaaaacctactgtcttcattggagtgcctcaaatttgggagaagatacatgagatggtgaagaaaaatagtgccaagtccatgggcttgaagaagaaggcattcgtgtgggcaagaaacattggcttcaaggtcaactcaaaaaagatgttggggaaatataatactcccgtgagctaccgcatggctaagactctcgtgttcagcaaagtcaagacatcccttggcttggatcactgtcactcttttatcagtgggactgcgcccctcaaccaagagactgccgagttctttctaagcttggacatacctataggcgagttgtatgggttgagtgagagctcgggaccccacacgatatccaaccagaataactacaggcttctaagctgtggcaagatcttgactgggtgtaagaatatgctgttccagcagaacaaggatggcattggggagatctgcctctggggtaggcacatcttcatgggctatctggaaagtgagactgaaactacagaggccatcgatgatgaaggctggctacactctggggatctgggccagctggacggtctgggtttcctctatgtcaccggccacatcaaagaaatccttatcactgctggtggtgaaaatgtgccccccattcctgttgagaccttggttaagaagaagatccccatcatcagtaacgccatgttagtaggagataaactgaagtttctgagcatgttgctgacgctgaagtgtgagatgaatcagatgagcggagaacctctggacaagctgaacttcgaggccatcaacttctgtcggggtctgggcagccaggcatccaccgtgactgagattgtgaagcagcaagaccccctggtctacaaggccatccagcaaggcatcaatgctgtgaaccaggaagccatgaacaatgcacagaggattgaaaagtgggtcatcttggagaaggacttttccatctatggtggagagctaggtccaatgatgaaacttaagagacattttgtagcccagaaatacaaaaaacaaattgatcacatgtaccactgactgctttgatggagctgctctcagctgttctgatgccttcagcaggaagacctcattgcaataagtgaaatgctgctctaggtagaagctctccctgctgtttttaagaagccacattcctcattggtcagtttcttgattgttcgtctgttggagaggtgctccctagaagaacctgccatacgtttcaaagcaataaaatcactgtatatctttctaaggaccttcaagtcatgactccagggaagcctattgggaagtctactaaaaactgcctgatttacaagaaagacctgaacttgtgggctcccatttgatttttttctcctcaggggactcagacattagaaagaaaaagcctcacagatttgaagaactggacccccaaatcaactcacctgcctggaagcaactgggaaacccttccaataagtcctgataataaagcacttcagggtc

SEQ ID NO: 1493 - DNA, 1640 bp, Homo sapiens
aagaatgggggctcgcggtggggtcgggggtctttcggggccttcaggagggctgcacccacaactcaacttatccgaaaacgagttctgcggggcagtcgcaggaatacatgaattctattacgagggccatagccccgttctgggcgagccttttataacaatgtgggttttgacagcccccaaggagaagccctctagggttggtgggtaccgagccagagtctgaacgtacggagggagatcacagaagggatcgcgaacatgaggtcctcgccggggctctgcagcccgccacctgaagaggagactttgtcccaagcccctgagagtgaggaggaacagaagaagaaggctctggaaaggagtatgtatgtcctgagtgaactggtagaaacagagaaaatgtacgtggacgacttggggcagattgtggagggttatatggccaccatggctgctcagggggtccccgagagtcttcgaggccgtgacaggattgtgtttgggaatatccagcaaatctatgagtggcaccgagactatttcttgcaagagctacaacggtgtctgaaagatcctgattggctggctcagctattcatcaaacacgagcgccggctgcatatgtatgtggtgtactgtcagaataagcccaagtcagagcatgtggtgtcagagtttggggacagctactttgaggagctccggcagcagctggggcaccgcctgcagctgaacgacctcctcatcaaacctgtgcagcggatcatgaaataccagctgctgctcaaggattttctcaagtattacaatagagctgggatggatactgcagacctagagggcaaactgactgctcaggggaagctcttgggccaggacactttctgggtcaccgagcctgaggctggagggctgctgtcttcccgaggtcgagagaggcgcgtcttcctctttgagcaaatcatcatcttcagtgaagccctgggaggaggagtgagaggtggaacacagcctggatatgtatacaagaacagcatgcgccaggtgttctgccagatgcaggaacttccacaactatggcacatcagccgagtggactttgtgagaaatgccattacccccagattgccccctctcatcttgttagcatccccagcctctgccctgaaccaaacctaattgtcctggtcttaagttctgcaacccacccactcccccagcaaacataactcctagtatgctttactcacaggcaagggaaaggatggggtttgaacccctttggcctggatatttgtaacttcccaactggtgcgggtcattacatttgctcctccaggtcccggggctctgcatcctgagctatccaacaccactgtactttgggacccgtgggcagtttcgctgcaacctggagtggcacctggggctcggagaaggagaaaaggagacttcaaagccagatggcccaatggttgcaggagctcactgacccaaagatttgcaccgtgtgggtctgacctcatcatgtggagtgcagagggccctgatgacatgtgtgtgatgaggaccatgacccttgaacccccttacctaacgtaactaataaaatgaagctgagagctttggaatcc

SEQ ID NO: 1494 - DNA, 2672 bp, Homo sapiens
atttgcctcattgctgaccctgtccagctggccatggccctcaacccccaaggcccttccacccacagaccatctcgctgctgagagatccaggacctgctcccacctggccaccctccccctccccccacatccaggccccagggctggtgtgtggcacccctgagaccacattgacctccatactgtctactacccataaggactccaagacgcccaggccagctgtctgggcaggactgatgcctgatcacccactgataccaagtactcatccccaagattgttaaacaaggccagacactcctggcctcaagaggatgggactgaaaaacaaaaagaacactgaagacccagaggagcccctgatcgcctcccagagcacggaacctgagatcggtcacctgtctccctctaaggagaccatcatggtcaccctccatggggctaccaacctgcctgcctgcaaggatggctccgagccgtggccctatgtggtggtgaaaagcacatctgaggaaaagaacaatcagagctccaaggcagtcacatctgtgacctcagagcccaccagagcccctatctggggggacacggtgaatgtggagatccaagctgaggatgcagggcaagaagatgtgatcctcaaggtggtggacaacagaaagaaacaggagttgttgtcctacaaaatccccatcaagtacctgcgtgtcttccacccctaccactttgagctggtgaagcccactgagtctgggaaagccgatgaagccactgccaagacccagttgtacgcaacagtcgttcggaagagcagcttcataccccgctacatcggctgcaaccacatggctctggagatctttctccggggagtcaacgagcccctggccaacaaccccaaccccatagtggtgattgcccgggtcgttcccaactacaaggaatttaaggtcagccaggctaacagggacctggcctctgtggggctgcccatcaccccactgtccttccctatcccgtccatgatgaactttgacgtgcctcgcgtcagccagaacggatgccctcagctgtccaagcctgggggacccccagagcagcccctgtggaatcagtccttcctcttccaaggccgagatggagctaccagcttctcagaagacacagccctggtgctggagtactactcctcaacttcaatgaaaggcagccagccgtggaccctcaaccagcccctgggcatctctgtgttgccgctaaagagccgtttgtaccagaagatgctgacaggggaaggcttggacgggcttcacgtggagcggctccccatcatggacaccagcctgaaaactatcaatgatgaggcccccacagtggctctctccttccagctgctttcctctgagagaccagaaaacttcttgacaccaaacaacagcaaggctcttcctaccttggaccccaagatcctggataagaagctgagaaccatccaagagtcctggtccaaggacacagtgagctccacaatggacttgagcacgtccactccacgagaagcagaggaggaacctctggtgcctgagatgtcccatgacacagagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccaatgaggcccagaacacggtgtccatgaagcagaaactgctgctgagtgagctggatatgaagaaactgagggacagggtgcagcatttgcagaatgagctgattcgaaagaatgatcgagagaaggagctgctccttctgtatcaggcccagcagccacaggccgctctgctgaagcagtaccagggcaagctgcagaagatgaaggcgctggaggagactgtgcggcaccaagagaaggtgatcgagaagatggagcgggtgctggaggacaggctgcaggacaggagcaagccccctcctctgaacaggcagcagggaaagccctacacgggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggatctcctctctggtacttcagacaagttcaacctcctggccaagctggaacacgctcagagccggatcctgtccctggaaagccagttagaggactcagctcgacgctggggacgagagaagcaggatctggccacacggctgcaggagcaagaaaaaggtttcaggcacccctcgaactccatcatcatagaacagcctagtgccctcacccactccatggacctcaagcagccctcagagctggagcccctgctgcccagctcagactctaagctcaacaagcccttgagcccccagaaggagaccgctaactctcagcagacctgagccccagagcaggcctccttccctgtgtgctggggagtctcatcaccgccccctaaaaatgacgttattaaatgttgtagctctgtg

SEQ ID NO: 1495 - DNA, 1952 bp, Homo sapiens
cccttcatgcatgcgcggaggccgcctgctagcaaggttcccacgtaacatcacatcagacccaagggcccgttcattgcaaggcgaaggaggcatgacaatggcacgtgaccatgggatcactggtcctgtcacattctgcaccacccagaagatactggcttgaacgaagagaagaaatgggctgttgaaggcgtagctgagatgccagctcagagacgatgataccaagtgctgaacctgagagcagccccagtacactccctgcatgggaatctccatctcaaagtcagcctccagggagcccgccctgaaacagattctgtcatggaactcaacagagtatcctggtgcggataaccagtgttgggagttagagcacggactctctccacctgcacggtgctggagctctgcacaccccctctgcagccatccctcgccgctgtcccttagctgacgcccttgccctctgtgtgtccttcctcatggcctgcaggtttcagatcccaagctacagatcatgtcttctagtctgggctctggcagagagttcggaagcactcttattatcttagcagcagcatgtgtggaaatcatttctcattacagcggagggcaggcattgtgcagagggttaagtgggcctgcttgaagttggttgttgttagctctcatgtctatgccttggtccctttcccctcaggacttggagagcaagctgtttgagtctgatgcaacccctgggctttgactatcatgccaaaaggcagcaaataagtgccttttcttcccttcagaatacatggacaatccaaagctctattagtctattattcagaatgaaaagtgtttacaatattcgtcctcttactcctcagtatgtgagactgttcctcgtagcaggtaatttcttccgaattcaaaaactcctcatggaagcatctgtttttgtcatcaaggagggggctgtatgtggaattgcaaggccaaagacatctcgggtcaactcttctcaggaccagatccaagtcgccagtgagaacacacattcaggcagcctccaccagcgccctgcctcaggagcgaggctccctgcttcatgtgggcaagagctgcccttgttttcccagcgggcagttgggggtctggagcctaggaagcaaagtgaagcacacactcctgcttccttccttccctgcagttgagacgggagtcttactttgttgcccaggctggtctcaaactcctggcttcaagcaatccttccactttggccttccaaagtgctgggattacaggcatgagccaccatgcccagcctccttctcttactagctgagaactaagagaagacactctggagacagaggaggaaacagtgacgatgccacatgatgaatacataatggagggtgaagacaaggctccgtcaggggcaccaaggagggaaacccagttctgtggggaaggtatggggcagcttcacaagcccagtgtctgctccctttgtgggagacgtgttgtttcagcatccattcccccttcttttaggaaaagtgcttgaatttccttttcatggaaccacccacctccctctcatccatgcattctattcccagtatcaggggtagacaagtgacttcaggcttggccaattagggttctgactcttggtcaaatcagagtgaatcctgagtcatttgtaaactccaaggaaagggcttgctttgttttctgttgaatgcagtgctctgagatagccggaaatgaaactgctctcttgccacactgaaggctagagaagggcctggccaggaaatgatgccagtgatcaggggtggagctggaagagggggagtgaggaggcccagacatcttgggagccccaaattcacctcaggatttaacttctccgctgctcagccaataaattcctttcttccatgact

SEQ ID NO: 1496 - DNA, 2087 bp, Homo sapiens
actgtctcttgttccccagctgtgtccacctacctttctgtcccccactcccccttttacttccctccctcccctccccctttcccttgcccattcttcctccacatgacttctcctttcctcattgattttccagcccggtcgccctcacccctcggaaaataccatagcgaccttgcctgcactcctgggtctccgccgccttgcaggaaaggattcagccccttcctcaacctcgagctgcctctggcgaccgggcaaggttacagcgaccaccctgtccatactgccggcccaaaccctggcaaaaggtgcaacgaatcctctcatcctctggactctccttgcttctccagagaccctttttcttgcctcactggaagccctggaatttcttctatgaccggcacgcccccctgcccaccccagccgattccctcgccacctccaccatctcttccacccccacaaccttcctcgcactcagggagatggtcttttgagtcctcttccccactcctggaaaggacctactgccgctagccctgccactcgggttccccactctccagcccttattttgagcagttcagcattccggggtcaccccctctctgtcagcggacaccttattgcagctggatgagtccctccagaatgcggcgtccctgtcttctaggctgccacagagcccaaattccctgctgttcgactggctttgcagaattttgacatggcttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacggatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactctat

SEQ ID NO: 1497 - DNA, 1814 bp, Homo sapiens
agtgcctggcaacctagaccagtcagggacgcggcaggaaatggaagagcctccgcaagaggctctggctgaacccttgaaacatgaaagcccagccgctccctcaagtgctggccacactaagggccaggaagaagacgaccagaagaaccaggccgaaaggaaggcagataaccacactgctcacagaatagctgaccagactgccctaagagtgcctagccaggctgaatccagcatatttagccaagctaccaacggagtagctgaacaaaatgggcatagtacacctggtcaggctggccgcagagcatccaaccctgctgatgtttctgaccttagagcagatgatcaggttaatcaaacaccgtctgaacagactaaaggcaaggcatctagccaagctaataatgtacagcatgaacagagtgatggtcaggtgtctggcctgacggaggaaagaactgctgaacagactgaacgaagattacctacccaggctgagagaagaacttctgggcagattgatggtagactggctatgccatctgaccagagaggttccagacagaccgaccacagaatggcaggccagtctgagagaagagcttccgagcagatggaccgcagaatgtctggcgaggctgagcgaagaacttctgagcagattacacacagattatccaaactatctgagagaagaccttctgtgcagattgacagtgggtcatccgtcccatctgaccaaagtccttctgtacagattgacagtggatcgtccgtaccatctgaccaaagaccttccgtacagattgaccgcagaatgtcagggaaagttaggagaagaagttctgagaagactgactacagattggctggcctggctgacccaggaacttctgagcagactgacctcagattgtatggcctcgttgaccacaaaacatctgtaaagactcaccaccaagtgtacggccaagccactgaactagctgaacaccaggctattgaccaagctcatagtaatgctgatcaacctccagttgacaatgctcactacactgaatctgaccagactgaccacttagcagacagacaagctaatcataaagaccagctgtcttactatgaaacacgtggccagtctgaagacagaatatttccccagttaggcaacagcaaagaggacaaagaggctgactacagagtacaaccctgcaaatttgaggatagccaagtagacctcaattccaagccttcagttgaaatggaaactcagaatgcaaccactatcccaccctacaacccagttgatgccagattcaccagtaacttccaagcaaaagaccaagctcttttcccaagactcccctccatcttatccaaattgaactataccagcagtcaagaaaaaactcaagccatagtaaccaaatctgatgaattttcagaaattgaccaaggaaagggttatcatatacgcaatcaaacttatagaaggttcccttctatagtttatgaagatccttaccaagtttcactccaatacatggaaaaacaccacattctgcaaatattccagcagattactgaaaacttagtctatgaaaagccagaggaccccctgaattttatgctgtgccaggtatagaattggagaaaaagaacaacctttttattctctttattgtaaaatacagcacacatacagcaaagtgtatagaacaaagtacgtacaactctgaattcttatgaagtaaacatacctgtaactaccattcaagtttttaaaaaataaataaaacataaccagc

SEQ ID NO: 1498 - DNA, 1678 bp, Homo sapiens
agatgtcatcttgatctaatcggaacaatttagtctagttgaggggaaggagccagcacttactaagtgatgactaaggcaggccggggcctacgcttggtgttatacacatttacaagcaacaatatgtttgggcaatctaaaaattatttatgcaacaagcaatcacctctggagggaaaaggaaaaggaacacagtaccctctcttgttttgggccaagtgtggactaaaccagctaatattaacaaatactgaggtgtttgaaaatgattactaggaaaccagaaatttttaacagaaattgttgaaaacccaaggaatgttaagaaagataaatcggacaggaaataaaccggtattttctggctccttttcataacaacagtgatagggtcagctaagttatagcaagaggggatgaatttgatcatccccaccccacctgtatagagagaagaagtctccattcttaatctagaaactcttaaaaggagctgccacccccacatctttccagattgctgggcagggctctctttttccagctttttacccacaaattgtgatggccaaacaccctcaccctcattttttacactcttagcaaagagatatgaatgcaaacagctactcaggtttgagaccaatcttctcaagaaaccatttctacacaagccctaagtgaagagaagaaactcaaccaaagtctacctgctgctttccagttcttctacttgttattttttatgtcaacagtaaataatttaaaatgattaacatggattccttggaatcctgcagccatgtgaacagttaaaagaaaattttaaaggactattagcttacctggaaccaaaccatgactaacctgcagggtatttactatttttggcctgtttataaacttcaagtacttccgtgaacaaagaaaggatggtaaacctgtctcaatcagccacaaacacatttaattccaagtatcagaattgtgtcaataacaattgtgtatgggtcctgggaggacaaaagccatggagaggtaatgtccactcctcagagtttcagagagatggagtggggaggtggcctgttggagttggctgtcaaggctaagatctggggaggtggtaggcagttgtgtcgtgtcctgtttcaagacaaggctctgaaacccccgtaagaagaaatcactgaaaatgcaaacactgagcagccacatcacagtccaggaggtgccgcttccacattttgtgctgctacatgtatgccgtgctctacatgggtcacagggggattctgccttggaagcaaagcaacagtaaagagtgctcaattcaattggtgaatattgatggaaggaggaggcttcgaattcctctggcttatttgaaagccacttgtaacacttccccagcaggagcaaacaataaaacactgagaagtacaaaggtaatacttccctcacaagtcaagatagcaaggaaggcatctggtacagagaagaactacctttacaatgatagggcagtttacgccaagacagtgatggacctaagcatgacctatcagattttgctttaaagaagaggataggttctcctttctccttaaatctatgttaatcactgaataacaaaagataataatatattaaaagctggtgaatgcggttgtcc

SEQ ID NO: 1499 - DNA, 1837 bp, Homo sapiens
aacaaccccagatggtacaacctacaacacacctaggctgtatgatgtagccaattgctcctagactacaaatctatacagcatgttgctgtactgaatactctaagcaattataacacaatgacctagcaacagtaacataagcaaaggagagtcacgcccaaaatggaaacccaaagccaaagtaccccttcagactctacatatgacttctgagaatcaagagaaagtgaaagctcttctccgagacctgcaagaacaagatgctgatgctggatctgaaagaggcctttctggggaggaggaagatgatgagcctgattgctgtaacgatgagcggtactggccagctggacaggaaccttccctcgttcccgacttggatcctttggaatatgctggcttagcctcagtggagccttatgttccagaatttacagtctccccatttgcagtgcaaaaactttccaggtatggtttcaatactgaacgctgtcaagcggtcctgaggatgtgtgatggagatgtgggagcatcactagagcatctccttacccagtgtttttcagagacatttggagagaggatgaagatctctgaggcagtcaaccagataagcttggatgagtgtatggaacagcgacaggaagaggcatttgctctcaagtccatctgtggagaaaaatttatagaaagaattcagaacagagtctggaccattgggttagaactggagtatctgacaagtagattccgcaaatccaagccaaaagaaagtaccaaaaatgtacaagagaattcacttgaaatctgtaaattttacctcaaaggaaattgtaaatttggatcaaaatgcagattcaaacatgaagtgcccccaaatcaaattgttggaagaatagaaagaagtgtagatgattctcatcttaatgctattgaagatgcatcttttttatatgaacttgaaattcgattttctaaagaccacaaatatccctaccaagctccgctcgtggcattttattccaccaatgagaacctacctctggcttgtcgtttacatatttctgagtttctttatgacaaggccttgacatttgcggaaacttcggaacctgtcgtatattctttgataacccttttagaggaagagtcggaaatagtcaagttactaacgaatacccaccacaagtatagtgaccctcctgtgaactttctgccagtaccctctaggaccagaataaataatcctgcctgtcataaaacagtgattccaaataattcttttgtttctaatcaaattccagaagttgaaaaaacatcagaatctgaggagtcagatgaggatgacggtcctgcacctgttatagtagagaatgaaagctatgtgaaccttaagaaaaagatttccaaaagatatgactggcaggcaaagtcagtacatgctgaaaatggtaaaatctgcaagcagttccgaatgaaacaggtgctcaatagccacatgtagccaggtgttgctgtattggacagcacaggtatagaacatttccatcaacacggaaagttctattggacagtactggtatagagactcttgttgggaagaactggatatgtgctaagcaagagggctttatttcacccagaaaatctttcggtttattcagatgttggaaaactaatgtacagattccacaactcattctggctgattctctgagcagcattctgaataaagtcttctacatccaatcccaacaaatccaacaaaggatcactcaaggccaggagtgcaagaccatccagggcaacataacaagactctgtctctataatc

SEQ ID NO: 1500 - DNA, 2649 bp, Homo sapiens
aagcgagtggcgctttcaccttagcaaccagcgcggctcccaccatggctgaagaagaggaaactgctgctctcacggagaaggttatccggacccagagggtgtttataaacctgttggattcctacagcagcggaaacatcgggaagtttctatctaactgtgtagttggggcttcgcttgaagaaattacagaggaagaggaagaggaagatgaaaataagtcagctatgctggaagcttcctcaaccaaagtgaaggaaggcacattccagattgtgggcacgctgtccaagcctgacagcccgcggcctgactttgcggtggagacgtactctgccatctctcaagaagaccttctcatgcgcctgctggagtgtgatgttattatttataacatcactgagagctcacagcaaatggaggaagccatctgggcagtctctgcactcagtgaagaagtcagccactttgaaaagcgaaagctatttattttactgtcgacggtgatgacttgggcgcgctccaaagccctggaccccgaggattctgaggttccattcactgaagaagattatcgaagaagaaagtctcatcctaattttctggaccacataaatgctgaaaaaatggttctcaaatttggaaaaaaggccagaaaatttgcagcatacgtagttgctgctggactccagtatggagcggaaggaggcatgttacacacattttttaagatggcttggttgggcgagattcctgcattaccagtttttggcgatggaacaaatgtaattccaacaatccatgttcttgatctagcaggagtgatacaaaacgtcatagatcacgtgccaaagcttcactacctggttgctgtggatgagtctgttcataccctggaagacatagtcaagtgtatcagtaaaaatactggccctgggaaaatccagaaaatacccagagaaaatgcatacctaaccaaggacttaacgcaagattgtcttgaccatttactggtcaacttaagaatggaagcgctctttgtgaaggagaattttaatattcgatgggctgcccaaacaggatttgtggaaaatatcaacactatcctcaaggagtacaagcaaagcagaggattgatgccaatcaagatctgcattcttggtccccctgctgtgggaaaatccagtattgctaaagaattggccaagtactacaaactgcatcacatccaactgaaggatgtcatttctgaagccatagcaaaactgggggcgattgttgcccctaacgatgtaggggaaggagaagaagaagtcgaagaggaagaggaggaggagaatgtggaagatgcacaggagctcctagatggcatcaaggagagcatggagcagaatgcaggtcaactagacgatcaatatataattagatttatgaaagaaaagctaaaatcaatgccttgcaggaatcaaggttatattttggatggattcccaaagacctatgatcaagcaaaagacctgttcaatcaggaagatgaggaggaggaagatgatgtcagaggcagaatgtttccctttgataaattaattatacctgaattcgtttgtgcactggatgcttcggatgagtttctgaaggagcgtgtgataaaccttcctgagagcatcgtggcggggacccactacagccaagaccgattcctccgggctctgagcaactaccgggacatcaatatcgacgatgagactgtcttcaactattttgatgaacttgaaattcacccgatacatattgatgtaggaaaacttgaagatgctcagaatagacttgctatcaaacagctcatcaaagagattggggagcctcgaaattatggtttaacagacgaagaaaaggcagaagaggagcggaaggctgcggaggagcggctggccagggaggctgctgaggaagcagaacgcgagcaccaggaggccgtggagatggcagagaagatagctcgctgggaggagtggaataaacgactggaggaagtgaaaagagaagaaagagaattactggaggctcagtcaattcccctgagaaactatttaatgacctatgtgatgccaactcttattcagggcctgaatgaatgttgcaacgtccgacccgaagaccctgttgattttctggcagaatatctcttcaagaacaatcctgaagcacagtgaaacttgaaagatctggtattatctacctttacagaaccacagatcacttattatactttgaaaaattgctttgaaaaatgcttttccagttcttagaaaattctttttttgtagacaaatattctataaactagaatctctattaaaagctatatgacatgactatgtcattaaaactatatttgaaatgtaaattgataaagacatttgtgcatagctcatgagacaaatactgatttaatattttattctttagtcagatctaaatataccgcttctgtacactaatgtttataggtatttatagcatgaagaaaatcagactatatattgtagactatgtattattctaacatgtaggctgatttacatgacttgttatcgccccaataacaatgttattagaaatggaaataaattgaagtgatttatg

SEQ ID NO: 1501 - DNA, 2083 bp, Homo sapiens
agaagcgagcggcaccccgggaccatcccacagcagatccagtggccgccaacgtcaggctggagttgcctccttcgtggatgttggatgtggaagcccaggagccccccaaggggaaatggtcgacgccgcccttcgacccgcgcttccccagccagaaccagatccgtaactgctaccagaacttcctggactaccaccgctgcctcaagaccaggacccgccgcgggaagagcacgcagccctgcgagtactatttccgcgtgtaccactcgctgtgccccatcagctgggtggagagctggaacgagcagatcaagaacgggattttcgccggcaaaatctgactgccccagcgcggcttcctctgaagatgcagtgatcctgcatctttttgtctcgcggagccccgggtctcggttatccacccctacctcccagtgtctaagccacgaataatggtagatgcctcgcgttgacagctacgagccagcccagggtccccagttctcaacactgtcccacccagatggctccaaggccaaggagtgccgcttgacaaagccctagggttccagcctggtcctgctgagggagccgtgagaccagtcagcctggggtgctggttttcccaacgggtactccctgagctatcagccttccagaggggctcctaggagggggaagccccatcctctgactgaagcggtcctatgaggccctgttcaaccccagggttcaaaggacacaccctagatgagccatcccccaggatgacgccacctctgagatcttggtctcctggctccgtctctgaccacaacccaagaatggggtgagggcacagggtgtggactcaactacaggagggcttcctgttcatgcaacgtccccagagccttgacgaatgcacagaggcgctggcagaaccacgggggcaggacccctctctgagtcacagaatggagctaagttggtgaggtcacccagccaccagccttcgagttccttgtttcccttgctctggtctccacgtgtatgatggggttctcaggcccaggcttcgaccagaggaccctctgccaccaccgtttcttcctgtccttgagctaccttggtgaactcatgaccccaggcccctgctccaccaggatgtcccccaggtcctgccagctgggaagtgccagcatgaacgcctccaacttcgtggaagccagggtcccctgcagctgagggacgccaagcagacacacctgccctccccagccagctcctgtctgtatgggcgagatgactgagagcgcccacgtccctaaggctgtcctgaccctccatgctgcgacaaggacagggaatggtcggtcactatgggcctggtgtctcccctcccccaccacccggtgctgcccagctcaagccagaagctgactttggccgccatggggacatcaggcaaggtctggagacatttttggttggggcagaggcatgctcctggcatcgagtgggtggagaccagagaagccgctcaacatcctgcaatgcatgggacaggccctgcctagaaacaccagctcagcatggcagcagtgcggaggccaggaaaccctgatcgccagtttctaacgccctcaccatttttatttttatttttattttttttgagacagagtttcgctcttgtcacccaggctggagtacaatgatgcgatctcagctcactgcaacctctgcctcccgggttcaagtgattctcctgcctcagcctcccgagtagctgggattacaggcatgcaccaccacgcccagcttattttgtatttttagtagagacggggtttctccgtgttggtcaggctggtctcaaacccctgacctcaggcaatctgcccacctcagcctcccaaagtgctgggattacaggcgtgagccactgcacccggctcaccactagtttttagccctttttgttgggggtggggtgggggcagaggagaggcggatacagaaacttgtgagaatgtgatgaacgctctgaaccccctataaaaaatgtgcatgtaaatatatactctcaacattt

SEQ ID NO: 1502 - DNA, 1978 bp, Homo sapiens
ttattttctccaacaaggctgagatagtaagcatgctgcagaaagatcacaaatttttgtatgaagtttttgcacagttaaaggatgagactacacatgatgatagacggtgtgaattgctattttttttcaaggagttatgttcattttctcaggcattacagcctcaaagcaaggatgcactatttgaaacgttgatacagttgggagttcttcctgctcttaaaatcgtaatgatcagggatgatttgcaagtaaggtcagctgctgcagttatatgtgcttatctagtggagtacagtccatccaggatccgagaatttataatttcagaagctcacgtgtgcaaagatagtgaccttttcattaatgtaataattaaacaaatgatctgtgatactgatcctgagttaggaggtgctgttcatttgatggtagttctgcatactctacttgatccacgcaacatgctgacaacacctgagaaaagtgaaagaagtgaatttctacatttcttctacaaacattgcatgcataaatttacagcaccacttttggctgccacctcagaacacaactgtgaggaggatgatatagctggatatgacaaaagcaaaaattgccccaatgataatcaaacagcacaactgcttgctttgatattagagctacttacattttgtatacaacatcatacattctacataagaagctatatcttgaacaaagacttgctaagaaaggccttgatattgatgaattcaaagcatactcacctgattttgtgtgttcttcgctttatgagaaggatgatttgccttaatgatgaagcttataataattacatcatcaagggaaatctttttgagccagttgtaaatgctcttctagataatggaactcggtacaatatgttgaattcagctattcttgagctatttgaatacataagagtggaaaatatcaagcctcttgtttcacatatagttgaaaagttttataacacacttgaatcgattgaatatgttcagacattcaaaggattgaagattaaatatgaaaaagagagagacagacaaagtcaaatacaaaagaatttacattctgtactgcaaaatatagtagttttcagaggtaccatagaagaaattgggctggaagaagaaatatgttttatggaagatgcaggagaagcagttatgccaccactggaagatgacgatgaatttatggagaccaaaagaacccaagaaggagaagcagttatgccaccactggaagatgacgataaatttacggagaccaaaagaacccaccaagatgaagaagaaaaagaggaagataaagaagatgaaacatcccccaagaagaaacctcatcttagctcctaaaatctatatggggcaccctcaaaatgtggctcaacaaaaattctataaacgtccataagctaaaaagactgattccacaagctttttcatgtgaacttataatgataaatcacagatataacgagttaagagggtttaattctgtaaaaacaaaatttctcataatcttaaaaaaaaatagtaaccagaacctgagtgataaactttttagcaagaaagtcttaatttgtgtcacgatttgggggaggaaaccatctttgggaaggaaagtcttagtttggaatggggaagaaccaggtcgataatgttaatgtagttttgttctagaggtatatattagaaataataacagttcagttaaaagcctacaaattacttgtataatggtactagccatggtattctttccttcagttacctttttaacacaaaagtttatgtttatatgaaaaacaaagttaactataaaaaatgttagtctcttcagacatttctataaagatataacaaaatttaagcttataagtaattggaaggaagtagctttcagagtgtactttcattcattaaaaaagcaagctggattt

SEQ ID NO: 1503 - DNA, 1692 bp, Homo sapiens
attgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatggctttctgttcaaaatcaggagtttgagataaataaagatggaatccccaaagtggatcagtttcatctggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatgtttctaggagctaatactgtgtccagaattggtgggttcttggtctcactgacttcaagaatgacgccgtggaccctcgcggtgagtgttacagttcttaaaggcggcgtgtccggagtttgttccttctgatgttcggatgtgttcagagtttcttccttctggtggggttcgtggtctcgctggctcaggagtgaagctgcggaccttcgctgtgagtgttacagctcttaaggcggcgcgtctgaagttgtttgttcctccgggtgggttcgtggtctcactggcttcaggagtgaagctgcagaccttcgctgtgagtgttacagctcttaaggccgcgcgtctggagttgtttgttcctccgggtgggtggtctcactggcttcaggagtgaagctgcagaccttcgcagtgagtgttacagctcataaaggcagtgtggacccaaagagtgagcagcagcaagatttattgcaaagagcgaaagaacaaagcttccacagtgtggccggcggctccaagtgcggggccgccaagcccacgcccacccggaactctagctggcccgcaagcgccacgcgcagccctggttccgcccgtgccttttcctccatgcctccccgcaagccgagggagccggctccggcctcggccagcccagagaagggctcccatggtccagcggcgggctgaagggctcctcaagcacggccagaatgggtgccgaggccgaggaggcaccgagagcgagtgagggccacgagggctgccagcatgctgtcacctctcaatacctctcctggcttccgggaccttaaagctgtccataaccaagatgtggaaaattgaggctcagaaaaaatgaacttgttgaaatctatccaggtggcacatggcatgattccacttcttggctcccatagggaaaagaagacaagtaaagagatgaagacttcttccaggaacctgaggtacttcattgtctgcagagatgcctcatcctacacccctcagtcactcatatctggatacattggaccttgtcaacatcaataatggacatacctctgatatttgaactctgaatctcactctgtgaccacaactttgtatctttctaagtctttaatcttcaacctcacagaactcttcataccctaaaatatagtattttcacctggtc

SEQ ID NO: 1504 - DNA, 1685 bp, Homo sapiens
agaagtacagacctgagtataatggagacctctagcctctaatcatgggcactaaaggggattgcagacttgaagggattgaaccaactactgcaagtcatgggcattcaatgttttgtaagagacaaccagtcaattcaaagatgcaggcaggcggagaaggatggccatgttcgccaaagcataatggaagatgttgatgaaaccgcactgttgaaacaaatggagcgggagaaaatgcctcctcctccaaagccaaagcatccagagtggctctgcatccccagtaaaactgtgcctgcaacacgtgggatccagtaagtaggagagtcctcacagggaagaagggaaagaaattcctaggatgctggggtgagggtaccccagaagaatgaccaggcagcaggcttgaagagcagctacccagattacacagtggtgcagcggtccatgaaaaaagcagagttgacggattatccaagttttggtggaaagtttgggataaattagtacaaaccatggcaatcaaaagctccaggaaaaacagacaggaaatgcatgaaaggctatgtcacagcaatatgccatgttgctaagccatggacaggatataatcacaatgatggaagccctgaatgcttattgaaccaaaaactgtgatgctataatcatatagagaggagagcagaaggatgggaacaggtaaatcttcacttcatgaaaagaagtcaagaggatcttctttttccttgatgttctgaagctacaagatgacttccaataccatgttgaataggagtggttttggtatcaggatgatgctggcctcatagaatgagctggggaggggcctttcctcctcaattttttggaatagtttcagtaggaatgggaccagctcttctttgttcatctgatagaattcagctgtggatccttcttgtcctgcgctttattttgttgagagttgcccaaggaagtcaacaggagagccaagtattttctctttatccatcaactttgagcctggaaaaggcactgtggcccctggtcatagttgcctttgtgacatcacggccatctctttctccacctttcctgcccctgccaagatcaggaaacagcaaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaaggcagctgggcagatccaggcctggtggcgtggggtcctggtgcgcaggaccctgctggttgctgccctcagggcctggatgattcagtgctggtggaggacgttggtgcagagacggatccgtcagcggcggcaggccctgttgagggtctacgtcatccaggagcaggcgacggtcaagctccagtcctgcatccgcatgtggcagtgccggcaatgttaccgccaaatgtgcaatgctctctgcttgttccaggtcccagagagcagccttgccttccagactgatggctttttacaggtccaatatgcaatcccttcaaagcagccagagttccacattgaaatcctatcaatctgaaaggcctggggcatggagaacaggctgcactaccctaataaatgtctgaccaggt

SEQ ID NO: 1505 - DNA, 1609 bp, Homo sapiens
actttcacctttcctggtgatgcctttggctccttgagctgagttttgcccgagtggggctcatgagggaggatggagtttcttgggactactcagaccgccagttactgtggtcccaagaaatgctgtggcttgacctcactgccagctgtacaggcgccagtgatccaggaatgctatcagccctactacctgcccgggtaccgctacctcaattcatggaggcctagcctcttctacaagatagccaacgtccagacctgcccggacgagagcaccagtaccctgcggccgcccaccatcctgcccacactgcgctccgcactcttctctcgctatagcccccacgactgggaccagtccaaccagctgcaggtgcgtggggccgaggcctcccggctgtgggccagccggctgacggatgactccatgaggctcttgcaggacaaggaccagctgacgcaccagatgcaggagggcacctgccggaacctgggccagaggctgtcggacattggcttctggaagtcagagctgagctatgagctggacaggcttctgactgagaaccagaacttggagacggtcaagaggcggctggagtgcgcggccaatgaggtgaactgcccattgcaggtggccttggagtgtctgtaccatcgagagaagaggattgggattgatttggtccatgacaacgtggagaaaaaccttatccgggaagtggatttgctaaaatgttgccaagaacagatgagaaaattagctcaaagaattgatatccagatgcgggataaccgggatgctcagcacgtgctggagagggacctcgaagacaaaagctcggcccagtgtatcgatgagaagtgctttaacctgagaaatacgtcagactgcatcagcttcttccacggcatggagaaaattgacggcacgatctccgtacctgagacctgggccaagttcagtaacgacaacatcaaacactctcagaacatgcgggccaactccatccagctgcgggaggaggcggagcacctctttgagaccttgtcggatcagatgtggaggcagttcacagacaccaacctggccttcaacgcccgcatctctgaggtgacggatgtgaagaataagctgcagacgcagctggcgaagacgctgcaggagatcttccaggccgagaacaccatcatgctgctggaaaggtccatcatggccaaggagggcccgctgaaggtggcccagacaaggctggagtgccggacccggcgccccaacatggagctgtgcagggacatcccgcagttgaagctggtgaacgaggtgttcaccatcgacgacaccctgcagaccctcaagctgcggctgcgggagacacaggacacgctgcagctgctggtcatgaccaagtgccggctggagcacgagctcgccatcaaggccaacaccctctgcatcgacaaggagaagtgcatgggcatgcgtaagaccttcccctgcaccccgcgcctggtgggccacacctgagcaccgccctggcgcctcattccgcgctggcgtaaaattggaaaaggctgagaaacaaagtaaaacagtattttgtttg

SEQ ID NO: 1506 - DNA, 2589 bp, Homo sapiens
tatgcacatacacacatgcgtatatacatgcacatatgcagatatgcacacgtatatgcacacatgtgcacatgcgtacacatgcaaacatgcatgcacacatgtacacacaccacacagacatgcactcacacgtacagacacacccaaacatgcgcatacacacgtgcacatatatgcacacatgcagatatgcacacatgcaaatgcaaacatgcatgcacacatgtacacacaccacacagacacagacatgcactcacatacacatgcacacacacaaacatggacatacacgtgcacacacacgcacacacacgcagtcacacacgtacacatgcatgcaggcacacagacacgcacatacaccacactgcacaaacatgcacacacagacacaaacacatgcgcacacacgtgcacatgcactcacaccacacacagacatgcacacacacgtgcacacaggcatgcacacacacgtacacagagacacacattcacaaacacataaatgcttgtgtgtggagacaactttctgcattcattgagcgtgagttttgttcatgaaaatccactggccccctttgctctttgaatgggtcttttacctatgcatgattttgaggaatcacacgctggtcatgtggagaattattcggaagctgtcacactcacaatgcgagaaacaagttttcaaaaattcctcttgtcatttgaaagctcaacattgtatcattggtgccagatactcccagctgttttccttacagggatgggcttacttggttgttttcaggaaaacacccaagcctgggtatgcagggctgttcgctgtttgttccatggaaactggtgttgcaagaataaaggagcttggttcagcttggctgccagacgcccacatggcacacacaaagcactgtgcgcaaacctccagctccatcacaaggaacgtcactgccgaatgctgctggcgatggtggcgagaagcctcacgagctcaaagccaccttgatctgggctcaggcaccagcaggtgtcccaccatcagccctttgccattgccgcgaatgtcaacacagagaaaaaggcaaggggcccgagatgactgtgctggtcttggagacccccctgaaaacacccaaaggaccacacgtgaagaactgctgttctgtggaacaaatgatgccaacgcttcaacaaatgcacagcccgaagagtctgggcagataaacaaggtgccggacacggccctgctgggtcctgtttcaaacaggccagacataaatagatgtgtggagaccccgggaaaacttccaggagcacttgggggctggagggaggcacacgggcctgcgcctgggagccgtgctctgcccactccaccccatgaccctcgaaggaagcacctcacggggcccccaggggtgcagggagtcagccgccctgttcctgtgtgagcggggcctctggggcaccgacctgcacagacctggtggggagaggccactccagcctctgggctgtcttgggtgaggcctgaagtggctcttcccacagtctgagcaagggctcagtcccaccagcagcaacatagcccagggcatggaagcccttgatgacgtacatggggctcgactcccacaaagccaaccccattgtggggtcagcacagctgcagagagtacccacgccagccgcagccatccccgaggagtgtggtgctggggacagtgagccgggtgtgtcaacctgtgaggggcacctgaggccagcatgagggcaggcgaggcggccgtggctcatgggtgctaggtctgcaggactgtgcccaggtgtaggctctgcctcccagccccacggcgaacacccatggtgcccctgccctgtagcaagaccctgacccccacacatgtccccagacacctcctggggcaacagtgctgccatgaggacctctgagatgaaggcaccggctccactgaggcctgtgtggttcccgccacctgcccccacacccttcctcctccacccgccctgcgctccggagtggcccggagcctgccccgtgggcgcccacagagtcaggcaccagcaggagatgaaggggcggaggaaggtgagagtgtcctcatcccaggcctcctcgtgaggtccctgcggcctggctgagcccctcccagggacaggcccctccgttgctcccctggaagctgctttcctcggacgtgggaacagccctgtccctgggccctcaggaatgggatagaacagggcccagggtgggaaccaacaccctaagtctcttcccacagaagcctaaggacagcaatggctgagggaggcgtcctgaggtgctcccgtggctgtgctcccatggctgtgctcccctcgctgtgcaagcatcgcagcgactcacacggctggagggcagggcccactgcctgcccaggcttcacggtgtggccctggctgcacacctgtgctgcaggtgcctgcgccgatccctggaggagctgtagtaagcatttgtgcatgtaaacacatccaagcttggaaatggcacagtaaaagcacagcaccgcg

SEQ ID NO: 1507 - DNA, 2200 bp, Homo sapiens
agcggaaggacggtgtgcgggccggccagccctggacgaaagaagagggcccctccaggccagtctgggcaccctgggatagcggctgcagcccgcccctctctccgtaactcagccatcagcaggggcagacggcaggtggcctggttgctgcagctcccaggatcagctctgccctcccgccaaacgccagcctcgtcaccgctccagggcacctccagcagtaacaggtggttgcagcaggtggcagccagcccctggatgagccaaggtctcttccccagccaggcatggccgactctgcacaggcccagaagctggtgtacctggtcacagggggctgtggcttcctgggagagcacgtggtgcgaatgctgctgcagcgggagccccggctcggggagctgcgggtctttgaccaacacctgggtccctggctggaggagctgaagacagggcctgtgagggtgactgccatccagggggacgtgacccaggcccatgaggtggcagcagctgtggccggagcccatgtggtcatccacacggctgggctggtagacgtgtttggcagggccagtcccaagaccatccatgaggtcaacgtgcagggtacccggaacgtgatcgaggcttgtgtgcagaccggaacacggttcctggtctacaccagcagcatggaagttgtggggcctaacaccaaaggtcaccccttctacaggggcaacgaagacaccccatacgaagcagtgcacaggcacccctatccttgcagcaaggccctggccgagtggctggtcctggaggccaacgggaggaaggcaatgttgcctggatgcacgtgctggcagcccgggagctggagcagcgggcagccctgatgggcggccaggtatacttctgctacgatggatcaccctacaggagctacgaggatttcaacatggagttcctgggcccctgcggactgcggctggtgggcgcccgcccattgctgccctactggctgctggtgttcctggctgccctcaatgccctgctgcagtggctgctgcggccactggtgctctacgcacccctgctgaacccctacacgctggccgtggccaacaccaccttcaccgtcagcaccgacaaggctcagcgccatttcggctatgagcccctgttctcgtgggaggatagccggacccgcaccattctctgggtacaggccgctacgggttcagcccagtgacggtggggctggggcctggaggcccagatacagcacatccacccaggtcccgagccctcacaccctggacgggaagggacagctgcattccagagcaggaggcagggctctggggccagaatggctgtccttgtcgtagagccctccacattttctttttcttttttgagacagggtcttgctctgtcacccagactggagtgcagtggtgtgatcatagctcactgcaccctcaacctcctgggttcaagcaatcctcctgcctcagcctcctgaacagctgggaccacaggtgcacgccaccacacctggcttttttttgttgtttttagagacagggtctcactatattgctcaggctggtcttgaactcctgggctcaagtgatcttcccacgtgggcctcccaaaacgctggaactacaagtgtgagccaccgcgcctggcccaagccctccacattttcaatccaggagccttgagtctgtgttgtgtcctgacacctccaagttctagggccgtcaggacacgggagggtttggggacagagtgtccttcctctgtcctctcatcccagtcctgatggccgcttggtgagtgtctggtgccctggtggcctgccccagctctcttctggctttctgagcaggaagcgagcagaggctccacaggcttacgctgctctcctgacagccacacgcgaccctcggtgcagagtgcagaggcggctctggttcctccagccacctcagtccctctttgggaggtgatgttcccattgtttttcaaaggcctcaccttcaactgtctgtcttagaattcccctctggagggctatggcctccctatgctttcacttcccacctctctacctaagttccttcccagcacatcgccagccctgggcctggggatgtccccaatgctgtacctggctgaccccggattaaaagcctcatccacg

SEQ ID NO: 1508 - DNA, 1687 bp, Homo sapiens
ccagggtgcgccttcgttgtcttctccaagctgtagttctacgtcccgacctccctatcataccacactcttcagcgaccacgcaggcactttcccggtccccagtataccataattgaagaaaaatgatggaagagagtggaatagagacaacaccacctgggactcctccaccaaatcctgcagggctggctgctactgctatgtcttctacccctgttccattagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaagggtgtggctgggaatcctatggtgaagtctgtgcttgataagacaaaacattcagtagaaagcatgattacaacgctggaccctggcatggctccctatatcaaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaaggtgctcaggaacggatagatagcttgcgtcgaactggggtgatccatgaaaaacagacagctgtgtcagtagaaaacttcattgcagaattgctgcctgacaaatggtttgacattggttgtttggtggttgaagatcctgtccatggcattcatctagaaacatttacacaagccacaccagtgcctttggaatttgtacagcaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactc

SEQ ID NO: 1509 - DNA, 1065 bp, Homo sapiens
acggtgggacccaggctttgggtagctggctccatgctctagcaaagcctcacttagcagtggggaggtcccaagaagagaagcgagatacccatataaagcaagcctgcttagccttccagggtccttcaaatcttaccaaatgaaagccagcttgctccacctactgtcaagccagcatctcattctccccattcttgtctctaaatggtctccccatgttgtccaggctggtctcaaactcctaggctcaagcgattcaccggctttggcctcccaaagtgctgggattacaggcgtgagctaccgcacccggccgcttcctctttcctaccagttcgccagcgtccacgtgtggctgttgtgtcatttttttcatttgctggaccattgggacttcagctgcaggtggcaggaggctccatccccaagtgtctccacggataaggacaggcaccatccagcccacaacccctccgcacccctaatcagtgtgacatgatgagacacaatcacagcttcaaatcacatccttggtaacttctgcttttttcaggccagggtcacccccatcatgtgtctatagtcctcttcagtgcaggattccaagctcccctggagcccagcctgtcctcccacaggacgtccttccagaccacaggacgtccttccaataactctcgtcctctcttcacagctgaactcacagaggacaatttaggcaggaaccgcacactgctatgacatatccaccccaccgtgctttctcgaggagtgatgtcccataccccctgctgagcagccctgtacagtggccactttccctggtagtaggtgacacatctacaaggtggccccagcagccttcagccctagagtctgactgccctggtccaagccatccctgccttgctggcctcctggggcccatgcaccctgttgacattcccctctccactgccctccactcaaagcaccaaagaagacttactcaatgtgtccttatggtgcagagtcccagcaagcagaggtctttgtatctgttgaataaaaaaattcctcatg

SEQ ID NO: 1510 - DNA, 1726 bp, Homo sapiens
agttctacggtgcggatgggggatggggcaggatggggcaggacaccgatatgctaaatacctaccaacagttggttaggaccccgtcggtgcgaccagggcaggacgtgcggctccaggctccaggaaccagaacggggctgctcaagctgctgtcgaccgtctctcaggacaagcagggctgcctggggagtggtgatggtgtgccaaatcaagacctgcagcagaggcctcagagctcaaggcagacagcaaagaaggaccgcaagcccaggggccagagcaagaaaggacagggctctgaagagtctgaagatcacttcccgcttcttcctcggaaaccctccttccccttccagtgggcctgggagagcatcgccacagatgtccgggctgtgcttcagccaagctccccaacccctggccaccaagccctgcccatgccctcctcgttctcccagcgtcagtccaggcgcaagtccacggccaacctcccagaggcccatggctgctgctggaagacagaggcgcaaaacctgaaggcgagacagcagctgggagcctggggcggtgtctccatccctactggcaaaggggagctaggatcagagccccccagtggtctccagctgcctgggaggaggccaggatcaggatcggcgtccgacaagcaggtccagctgcaaagcctgggtgctgaggaggccgagaggggtctgagttctggggtgctgccccagcgccccaggagggggtcgatctcagaggaggagcaattttcagaggccacagaggaggctgaggagggagagcacaggactccctgcagaaggagggctggttgtcagagaaaggggcagatttctggagaggaagcctccgatgagggagaagtgcagggccagagccaggggagcagccccagcttcaacaacctccgaaggcgacaatggaggaagacaagggccaaggagctgcaggggccatgggacctggagaagctgcacaggcagctacagagagacctggactgtggcccccaaaagctgccctggaagactttgagggctgccttccaggcctccaagcggaatggaaaggcctatgcctcgggatacgatgaaactttcgtgtctgccaacctccctaatcgcaccttccacaaacgacaggaagccaccaggagcctgctgcaggcctgggagcggcagcggcaggaggagcggcagcaggccgagctgcggcgggcccggacacagcatgtacagcggcaggtggcccactgcctggcagcctacgcacccagagggagccggggccctggggcggcccagcgcaagctggaggagctgaggcgccaggagcgacagcgctttgctgagtaccaggcggagctgcaaggcatccagcacagggtgcaggcccggcccttcctgttccagcaggctatgcaggccaatgcccggctcaccgtcactcggcgcttctcccaggtgctgtcagcactggggctggatgaggagcagctgctgtctgaggcaggaaaggtggacagagagggcacccccaggaaacccaggagccacaggtcaatgggggtgagaatggagcactctcctcagaggcccccaaggacagaacccaccggcagccagcctgacaggcactacaaccccagcctggacccggagtgcagtccctgagataaaattaaaggctttatggc

SEQ ID NO: 1511 - DNA, 2142 bp, Homo sapiens
atgcaaagctagactgagcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagatgaggcgtgcagtcaatccgaatcactcgctgagatgttgccccttccagggtcactcgtcgtgtagacgctgcctttgtgcagctgagggaacagcccttggcccctgccacacaatacgtatttatattcacatgtgcctgttgtgggagcagggccagcagatcaccatgatgaggggatcacaagaatcatcactgcggaagacagactctcgagggtaccttgtgcgcagtcaatggtctagaatatcccggagcccatccaccaaggctccatccatagatgagcctagaagcaggaacaccagtgctaagctccccagcagctccacgagctcccggactccatccacctccccaagcctgcatgactcctcaccgccgccgctgtccgggcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggaagagcctaggctggatgtcttgatcaataacgcagggatcttccagtgcccttacatgaagactgaagatgggtttgagatgcagttcggagtgaaccatctggggcactttctactcaccaatcttctccttggactcctcaaaagttcagctcccagcaggattgtggtagtttcttccaaactttataaatacggagacatcaattttgatgacttgaacagtgaacaaagctataataaaagcttttgttatagccgg

SEQ ID NO: 1512 - DNA, 1907 bp, Homo sapiens
aaaaaagccagcgaccgttctgcctcccgtgggggaggaggagcccaaaagccctgtgctggtggatggggagaaggaattataggagctggagaaacaacatcttctggaagggaagacaagacagtatacaatcccctacagaggagtaccagtgctccggggtcctcgagaccgacttcgccgagctctgcacgcggtggggctacacggacttccccaaagttgtcaaccggccccgcccccacccgcccttcgtcccctccgcctctttgtcggaaaaggccaccttagacgatccgcggctgtcggggtcctgcagcctcaatagcctggagagcaaatacgtgttcttccggcccaccatccaggtggagctggagcaggaggacagcaagtcagtgaaggaaatctacatccgcggttggaaggttgaggaacggattctgggtgtcttctctaaatgtctgcccccgcttacccagctacaggccatcaacttgtggaaggtggggctgaccgataagaccctgaccaccttcatcgagctcctgcctctctgttcatccacgctcagatctcccctgccctcaggaaggtgtctctggaggggaacccactgccggagcagtcctatcacaagctcatggccttggacagcacgattgcgcacttgtctctgcggaacaataacatcgacgaccgcggggcgcaactcctgggccaggcgctgtccacgctgcacagctgcaaccggaccctcgtctcgctcaacctgggtttcaaccacatcggtgacgagggcgcaggctacatcgcggacggcctccggctgaaccgttccctgctctggctgtccctggcccacaaccgcatccaggacaagggcgccctgaagctggctgaggtcctgcgcgccttcgagctgacacacaccgaagtggtggagcgccgacgcctcctgctggaaaaagggacacaggagcgctcgcgatcgccctcctcctctcgacacggggactccaaaacggaccgtgagaagagtcagatggtagggatcagcaatagtgcattggtggacaagacagacaagacgcagacaatgaaaacccctaagggcctgggcaagaaaaaggagaaatcatgggaattggccaagaaagaggagaagttggggtctgggcagtcacccacacaaggaacccctaagaaggaagatgccacaaaggcaggcaaggggaaggtaaccatccctgaacagaagccaagcagggcaaaagggatcaagatcgggagcagagagaagcgcagcatcctcctggagtccgagcagctggttgttgaggctactgaggtggtcaaccctctcctggagcctgtggagcaccgagatgggaaagttttcatgcctgggaacaaggtccttttgcacctcaacctcatccggaaccgcatcacagaggtggggctggagggcttcctcgccacggtgcagtatcagatgcagttctccaaggccaagagtgcatccaagggtccagtggggctgctgtggctgtccctggctgtgagtccctttcactctctcctgctgaagcagacgttgcccctatcagctgtcatactagacagctgctgcaggcagcttctgtctccccatttccaaggaagaaaaattgcttcgccccacaatgtcctgcgtacgccataatccaggagctgatgttgccaagggatcccatcaaggccaaactcagggaggatgaggccatggcattcttcccctagccccctcccacctgcttgcctctaagactcggggctacagaagcacctcctgtccctgtgtggggtgacctccctgggggagatctcagaccaataacaaagtctgttgctatactttt

SEQ ID NO: 1513 - DNA, 1756 bp, Homo sapiens
attgtgagcagcaaaacctgtgcgactgcatctgacatcgccaggatgggggcccaaccaagatccccagagacgtgaagatgcatggaataacacgtgaagagaggaaacttcgggcctgtggtcaaaatgtgttcaccacggcagacaactgcttgggtgacagctttggcctctggatgaattctccttggcgagcaatcgtcccacctgtaggtgccttcatgatcgtctgtgtgcagggcaccaagcaggccatctaaagccactaatctcaaagagagcttacccagggacaggactttccaaaaggaaaggagcacaatagaagagaatggctgctgctaagttccatccaacagtggcctcttttgaaaagtcgtcctcatccacagatggtcaacattatgatggaattttgttttcctctcatgtgaatttggagctgatagatgcttctcagctccttgctgggacctcactgacaaacccgctggccccagaactacttgtgacatcaggatgacgcttggtacaagccaggcactgagctgggcattgaggatgaagagatgaaacacaattctagcatctaaatagacctttgttggaagttgagttccagagtgggatatcagactcaaggcccagacttcacttctggtctcctgacttccaagtgaacagtgttgcagcttccctgactgcagttataggagaagacagggaggagataaagatgagagtgcctcgggaagagcagggatggaggagacaacctgagtcttctgatccaaaggagtgtgaagatggagtgacattgagagaactgcagaagaaagggacttggcatttatggagcatacacctgtaccatcatatcaaaatgcaacacagctattgcctcttggaacattataatagaatggggaaatcaagtatataaagagtcatgtgaaattggcaagacaagcatcaatttacagaggaggaaactgaggtccagagagatcaattaaactgtctaaagtcacatggcctgacataaaagtagtggagagtcaaactcagggctatgtacctgcggtggtggacttcatctttccaatcctacttccttatctgtgaagtgggcaaaccaatcatttttaccccagagagctgtgaagaacctgtatcagttatacagaaagttaaagaacttatcgcagtgcctggaagccaggatgtggagccaggagagaaggggcattcaaagggcctgggagacccttggtgaaaacaatcagttggtttcaacatcccagagagattctcaatcaggtagctcacagagaccaaagttggcacacagcactctcctaacactaaagactctacaactccttcttcatgggatgtgtgaaagcacagagagatggagacatggctgcttggaaattgtccttaaaggaaccacaggcaagcgggaggtagaaatcaaaaccagggtggctgccacaggcgatgaagctagagtgaaagaggttggctgaggttaaaccaaagaacagtccagaagatgggagaatcccaacaaattttcagtcagtatttcccaaagtgggttcctgaaaattgttcctttagaaaaagcatcatagtcaagcacatttaggaaactttccttaattcccctctctttgaaattcacaagcccctttgacatattaaagtttctgtaaagtcagtgaataaagaaacctgtttacatttg

SEQ ID NO: 1514 - DNA, 2635 bp, Homo sapiens
ttgattctggggccactcaccagaagacactggatcctccctcagactttaatccttctctgaccctagccaccaccctcagactagaggttcctaaccatcccctctgacctgacagagccaccctctctgtcctaggctgagcctgcagcctccctactcagatcagacagcacgccgcctcccttggtgcccctgctctgtggcacctgctgggatgtccctgggatcccgagagccaggggacatcccccggagtccagccacccccacggagggtccggctggccagcggctgtttgttccgtctgcctgtcgcctaatggttccaacaggcatggggcggcagccagggcgggcgcggcctttgccgagtgagctcacgtctgcccaggcaactgggccaggggtgggcagagggcatgtgggctgggcactggggtggaggaaagaggagacctggggtcacctggggtggcagcctcgatcttccccatcagagggatgggtgtgacccttagcctcagccaagtgtgggtccatccaagctggggagattgaggttcagacaggcaggggcgaccaggagctggggcacaggggcctccacccaagccccccaggccccaatgtgcccccctctgcctggcatgcctgaggggatgtccaggctcacgagggggatggacagcagcttgagcgtggccagcgcgcgggtgcaggggcccccgacctcgcccggctccacgccggggcccagtacggcatccaccaccagcccataggcttcgttaatgagctgcacctggggaaggcaggcagggtcagggtggcccagggccactgcacaccatgtcccccttgcttgccacccagcgctgacctcagtgggcaggtagctcaggaaggggatgtccatcttctcgcactgggtggtcaggtcccgatgcagcaggtccagcgagcgtgtggggtagaagatggtgggttcatactcctgggggtgggagaagagggggtcagactcccctgacctggtcaccagcaccagaccctgcctgggacaagcactgggcatattctataacctggccctgcgtcaatgtccccctgggaagctatcaaaagaaggcagtgatttctgcaggggcagggactttgggaggtcgaaggggtccttgctacttacaaacacccgcaggtgccgggcacagaccagccccactgccccgttctgctccgggccacacacgaccagcaccgtcctctgcttccgggagagagcgggcaacgggaacgcctggtggtaggggacacagcaaaggcacaggcacagtccagattcctccttgcctggagaggaaactgaggcccggagtaggggaagggatggggcttgggcctggaggcaacaggataggacaggaggtgagctgttctggatgaggggttgggcctcttggggcctcagtttccccgctggagatgcagaggcccggtctcaggctctgccaggtcggtgcaggaaaaacgtgcatccagccactgcccgtcgcccggagtgcggtttgtttattctccgcctgagttgcagacattcttccacctttctcaccgcgggcccacccccgcccatgtttccagacctcagcccctcctggaggctgtggagtaggggagcccaaccttagccacgatgccctggggcctctctgtctctctctggctgtctctgtgtctctctgtatctctcagactctccgtgtctctgtctctctgtgtgtctctgtctctctgtatgtctctggctctcttcatgtctctctccccacctgtctctggctgtttctgtatctctcagactctctgtgtctctgtctgtctgtctctgtctctctccgtctctggccgtctctgtgtctgtctgtatctctcagactctctgtgtctctggctctctttgtgtctctgtctctctccatctgtctctggctgtctctgtgtctgtctgtatctctcagactctagtgtctctgtctttctgtatgtctctggctctctttctccatttgtctctctctccatttgtctctggctgtctctgtatctctctgttatctgtctctctccatctgtctctggccatctctgtatctctcagactctgtctctccaggcattttggccccagccctgccctgattctgcgtggccccagccccttctctcccagactcagtttggcctttatcaaatgcgatgacagtgccaccgcctgacaggcactctgggtgtctcttgagccccagctgtactttaagctccaaccacacagacagcagattactcccctttcaagtatcctccccaaaggcttagcgcagtcctgacctgccatgaacatgcctgcgatcccagccacaccgggcccagagcccaagacccaagactgggactgaggggcttctggacagacaaggggctttcagtgcaaaaaccagacagttggccactgagcgccaggcgagtagtgactactgggtttctttctggggttttgattttccttctcctttgggcgcctcacccgggatctatttcatttggaaatacaaacatttaagtccacatgaag

SEQ ID NO: 1515 - DNA, 1966 bp, Homo sapiens
agtaaccccgagtctgcggaagtggtgacccgtgggacgcggctgagacaggagactgaaaggaaccataatttgtgacatcagttgttttctttgataagcagctatttatgattctggaagattaaggcagataggaaaccccatctgagattttaataaatccctcaaacaataaaccacatcatggacatacagctggaccctgccagagatgacctgcctctcatggccaacaccagccacatacttgtgaagcactatgtactggatttggatgtggattttgaaagtcaagtcattgaggggaccatagtgcttttcctcgaggatggaaacagattcaagaaacagaatagctctattgaggaagcctgccaatcagaatcaaacaaagcctgcaaatttgggatgcctgaaccctgccatattcccgtgacaaatgcaaggaccttctcatctgaaatggaatataatgattttgcaatctgtagtaaaggtgaaaaagatacttctgataaagatggtaaccatgacaaccaggaacatgcttctgggatttctagctcaaagtactgctgtgacacagggaatcatgggagtgaggattttttgctagtgttggactgctgtgatttatctgtgttaaaagtcgaggaggtggatgttgctgctgtgccaggtctggaaaaatttacaaggtctcctgagctcacggttgtttctgaggagttcaggaatcagattgtacgtgaacttgtgactttgcctgcaaatcgttggagggagcagttagactattacgctcgctgcagccaggctcctggctgtggggaactcctctttgacactgacacttggagcttgcagataaggaagacaggggctcagacagctactgactttcctcatgctatcaggatatggtacaaaactaaacctgaagggcgatcggttacatggacctcagaccagagtggcaggccatgtgtttatactgtgggatctcccataaacaacagggccctttttccatgccaggagccacccgttgccatgtcaacatggcaggctacagttcgagcagctgcatcttttgttgttttaatgagtggggaaaattctgccaaaccaacgcagctttgggaagagtgctcaagctggtattactatgtaactatgccaatgccagcctccaccttcacaattgcagtgggatgctggacagaaatgaagatggagacatggtcatcaaatgatttggcaacagagagacccttctcaccttctgaggccaacttcaggcatgttggtgtttgcagtcacatggaatacccctgccgcttccagaatgcttctgccaccacccaggagatcattcctcatcgggtctttgcccctgtgtgcctcacgggtgcctgccaagagacccttctgcggctgatccctccttgcctctcagcagcacattctgttctgggagcacacccgttctctcggctggatgttctcatcgtccctgccaactttccaagtctggggatggccagcccacacatcatgttcctctctcagagcatcttgacaggagggaaccatctctgtgggacccgcctctgccatgaaattgcccatgcctggtttggcctagccatcggggcccgagactggacggaggagtggctgagtgaaggcttcgccactcacttggaggatgtgttttgggccacagcacagcagctggccccctatgaggcccgggagcagcaggagctgagggcttgtctgcgctggcgtcgcctccaggacgagatgcaatgctcccccgaggagatgcaggtgttaaggtttccacatgttggcggatgcagtggaagcttctcttgagatctttgccacactgttcaacatgtttgaccactctgtcctaaaaacgctttcttcttaaagcactttctcctcctgg

SEQ ID NO: 1516 - DNA, 1953 bp, Homo sapiens
agcgacttcgtgctcggccagttctgcttcctgcagcgcctcctgctggtgcacggccgctggtcctacgtgcggatctgcaagttcctgcgctacttcttctacaagagcatggccagcatgatggtgcaggtctggtttgcctgctacaacggcttcaccggccagcccctgtatgaaggatggttcctggctcttttcaacctcctgtacagcaccctgccagttctctacattgggctctttgagcaggacgtgagcgcagagcagagcctggagaagccggagctgtacgtggtggggcagaaggacgagctcttcaactactgggtcttcgtccaagccatcgcccatggtgtgaccacctctctggtcaacttcttcatgacactgtggatcagccgcgacacggcgggacccgccagcttcagcgaccaccagtcctttgcggtcgtggtggccctgtcttgcctgctgtccatcaccatggaggtcattcttatcatcaagtactggaccgccctgtgcgtggcgaccatcctcctcagccttggtttctacgccatcatgactaccaccacccagagcttctggctcttcagagtatcccccacgaccttcccgtttctgtacgccgacctcagcgtgatgtcctctccctccatcctgctggtggtcctgctgagcgtgtccataaacaccttccctgtcctggccctccgagtcatcttcccagccctcaaggagctacgtgccaaggaggagaaagtggaggagggccccagcgaggagattttcaccatggagcccttgcctcatgtacaccgggagtctcgtgcccgccgttccagctatgctttctcccaccgtgagggatatgcaaacctcatcactcagggcacaattctgcggaggggaccaggggtcagcagtgacatagcatctgaatccctagacccatctgatgaagaggcagcttcgagcccaaaagagtcacagtgacacctcaggaagatgtccttcctggggaagaagaagcaccagccacaggggcaggtgtcctcccaggaagtacagctcccccctacacctagctcatcattttctatggatagacaatccgctcttcatccagaaaaccaacctgccctccccaaatatgtgctcaccagcagcaacaggctatctgagtctttccaagagcaattgccaagggcacaggagaggtcattgtcacccaagcagaggccaccttctcctgagaagttgctgttgaccaaggagaggtcacattcttttcaggagaaatcactgttgcacagagaaagccagctgtcgtcatttgagagccagccacagcctctggggagccagtcatttctttcaggccagctgacgttggagagccagccagactcctcggaggagaagtcagcatttttgaagccctccacaccgttccggaagagctggcaaaaggagcctcacacccccaaggaggggacggtgccacttccagacaagacccacaaatctcaggtggagactctgccaccaagtctggaagaatcgtccacgtccacgagcgagcagcctatggaggtggagctgtggcccgcggagaagcagtcatcatcatccatggagtggctgctggtgcccggggaggagcagctatccttgcccccagaggagcagtcattgccctctgcggaggggaccagggttcagcagtgacgtagcatctgaatccctagacccatctgatgaagaggcatcttcgagcccaaaggagtcacgctggcatatcaggaagatgtccttcctgggaagaagaagttccagccagttctgctgcaagtcaaccagcatgcagggggccttcctctaaagacaaggactccacatgcttttctttttctaataaaccagggtccatctgaccccagcgct

SEQ ID NO: 1517 - DNA, 1671 bp, Homo sapiens
atgcctgattaagcgtcatggggtctttcatccagactgcgttttcattattcgctgaaacatacaggttttaatttttacgaggctaaggccacggccgcctcacctcggtttttgccgccacctagaggaactatgtgcgccccaacggttgcccggctttgcgcaggtgcacagtactcgctatggcccattcgtcacgtgacgagggcgggactgtggcactgtggaggggcgcctagtaggcaggcgctctcagctctctccccggtacgtgacgagactccacggacgtcacgtgaggcaggcggcgagcgcgggtggggcggggttaggcggcgctccgcgagaaccaaagtgcagccgctgacccggcaaaactcagcgggggctggatagccatgcccaagtactgcagggcgccgaactgctccaacactgcgggccgcctgggtgcagacaaccgccctgtgagcttctacaagttcccactgaaggatggtccccggctgcaggcctggctgcagcacatgggctgtgagcactgggtgcccagctgccaccagcacttgtgcagcgagcacttcacaccctcctgcttccagtggcgctggggtgtgcgctacctgcggcctgatgcagtgccctccatcttctcccggggaccacctgccaagagtcagcggaggacccgaagcacccagaagccagtctcgccgccgcctcccctacagaagaatacacccctgccccagagccctgccatcccagtctctggcccagtgcgcctagtggtgctgggccccacatcggggagccccaagactgtggccaccatgctcctgacccccctggcccctgcgccaactcctgagcggtcacaacctgaagtccctgcccaacaggcccagaccgggctgggcccagtgctgggagcactgcaacgccgggtgcagaggctgcaatggtgccaggagcggcaccaggcgcagctgcaggccctggaacggctggcacagcagctacacggggagagcctgctggcacgggcacgccggggtctgcagcgcctgacaacagcccagacccttggacctgaggaatcccaaaccttcaccatcatctgtggagggcctgacatagccatggtccttgcccaggaccctgcacctgccacagtggatgccaagccggagctcctggacactcggatccccagtgcataaggatcaagacagacaatgtcgagggacaaaagatagaagatggaggaggaaagacatacgtgggcttggcccagccccaccgcccacgcctgggtagtagcagtgcctccctcaagggcctgggttctaccaccccactcctagggatctcttgaaccttaggggtgacctgggcccaagtctctcatcagcccccaatcccctgggtaccaggcttctgccacccccggctcagatctttgcaaatcagtacgacagcctcagagcagagcaagggttgtttgggagaatcatacctggttctaaggagtcccacgctttttgccaagcctggtactgagttcatgataccatggtggacacagctgagaaaatccctgccctcatggtgctcattctacttgagtagacgatgaactagtaaacaaataaacaagaacactgc

SEQ ID NO: 1518 - DNA, 1927 bp, Homo sapiens
agctgatggtatggtaggaggagtggagtggagctcttgccttgttactgaggaaatctatttgtttctagtattactggatttttggggaaaaatttgtagtcctccccttgaaaggcaaaggggctagttgtgccatttgcctgcacaggaaccatgaggagacatatggtaacttatgcctggcagctcctgaagaaggaactgggactgtaccagctcgccatggatatcatcataatgatccgagtgtgtaaaatgttccgccaaggcctcaggggattccgggaatatcaaatcattgagactgctcactggaagcaccctatcttctccttctgggataaaaagatgcaaagccgagtcacatttgataccatggacttcattgcagaggagggtcactttcctccaaaggccattcagatcatgcagaagaagccttcctggagaacagaggatgagatccaggccgtctgtaacatcttgcaggttctggatagctatcggaactacgcagagcccctgcagctgctcctggccaaagtcatgcgctttgaacggtttggtcgcaggcgtgtgatcatcaagaaggggcagaagggcaacagcttttatttcatctacctgggcacagttgcaataaccaaggacgaggatggcagcagtgccttcctagatccccacccgaaattgctgcacaagggtagctgttttggggaaatggacgttctgcatgcttcagtgaggaggtccaccatcgtctgtatggaagaaacggagttcctggttgttgaccgggaggacttctttgctaataagctggaccaggaagttcagaaggatgctcagtatcggtttgaattttttaggaagatggagctgtttgcatcatggtctgatgagaagctctggcagctggtagccatggcgaagatagagaggttctcgtatgggcagctgatctcaaaagattttggagagtcacccttcatcatgtttatcagcaagggcagctgtgaagtcctgcggctgttggaccttggggcctccccttcctaccgtagatggatctggcagcacctggagctgatagatggcagacctctgaagacccacctgagtgaatactctcctatggaaagatttaaggaattccagatcaaatcatatcctctgcaagactttagctccttgaaacttccacatctcaaaaaagcctgggggctacaggggacaagcttcagcaggaagatcagaacctcaggagacactctctccaagatgctgggcccgaagatccaatccaggcctgctcagtcgatcaaatgtgccatgatcaatatcaagcctggtgagctccccaaggaggctgcagtgggggcctacgtgaaggtgcacactgtggagcagggagaaattttggccttccttccagagggtgaatgcgacacacgacccttgatcctgatgagcctgggaaatgagttgatacggataaggaaggaaatattttatgaactgattgacaatgatgacgagatgataaaaaagttgttaaagctcaatattgcattccccagtgatgaagatatgtgccagaagttcctccagcagaacagctggaatatctttcggaaggacctgttgcagctgctcgtggagccttgccaaagtcaactgttcactccaaaccggcccaagaagagagagatctacaaccctaagtctgtggtcctggatttgtgcagcatcaacaagacgactaagcctcgttatcctatttttatggcaccccagaaatacctccccccattgaggattgtccaagccatcaaagcacctcggtacaaaatccgagaactcttggcttagtgtaagagcacaggggtccttatttaggacaaataaaggatggtggattggg

SEQ ID NO: 1519 - DNA, 1710 bp, Homo sapiens
agtctcttcttgcaaggcctttcgcccctggtctatgtgcgcctagtccatgttgcctttcttttccaacaccacctccaagtccgtgtctgtttcctcctttcaagggtctcctgctaccccactctctttccttttctttttcttcctttgcagagccggctcctcaatgactggctgctttaccttcttcttggacttcatctttttcttcgcgggggttttagggccatctcctatggggatgtattccggagcctccactttgactggcttctttttacttcgtttcctagggcagctctccatggacctggagggcttggagtggcttgggagggcgtctccctcctggtggatttttttttcttcttcgccttcccaccgtgttccctggggctcttgtgcttccgcttctgccccaaggctacctgttcctcaccctccttccccactgagcaagtgtccacagcatccccgacctcgcagaaccaagggtcctggactgagaaagctgtggggtcctgggccccctttttttccttcttaagttttttaagcttcttgccaactctggtttcctcctcaccctgtctggggtctggggagattttcaccccagaggcatgggagatggccagagatgacttccttttcttctgcccactgaggaactccaaatggccaagcacctggttccttgggctggatgacttctctgtccgtctggcacgcagcgtggtctcaggttctacgtgcccctcgcaaagggtgctgacacccttctctttcttctttttcttcactagaggcatctcaggtgcctgcccgtggaccacactcttagagggggctgtggcttttataggagaaacatgggcaaagtaatcatcattgtttaaaattgagtattgagtccctggttctttgaccactttcttcttctttttcttctctgggatcccagggcccaggtctactttccggtgggccaaacttccccgcctccacgtgagagccggctccgccgtgacccggaagtccactttcgggttgcacgcgtggcttctcttacacacaaattttcttccacttctgccactcctgagacagcaagactgataccttattttcctcctcctccttggcctactcaacatgaagatgatgaggatgacgacctttacgatgatccacttccatctaatgattgaggcagtgtctcactctgttgtccaggctggagtgcagcgatatggtcatagctcactgcagcctcgaactcctgggctcaagggatcctgccacctcagctaaggcctgcagtagctaagactataatcccttaaatattttagaagagaaggagcaagagaagaagatctcaaaatactttttcaacactggctggttttgagaagctcactttcaaaatttgatatggacattgcatttgacgagacagtagagatgggatttcactgtgttggccaaactggtctcgaactcctgacctcgggatccacccgcctcagcctcccaaagtgctgggattacagccctgagcgaccgcgcccagccgtcacaggatttcatacttattaagatccctctttcttctttaggattcccaagtaacttgtctctgctatttttaatgtatatgaccgaataaattcaaaatgagccttatgaaaataggctaaggtc

SEQ ID NO: 1520 - DNA, 2067 bp, Homo sapiens
acattttcatggtaacaccaaaacagaatgggtgcagacgctctcctgtcttcgcagtgaagctccaccacatggccaatgaaggccagggcgccaggagcaatgaagctgaggagaagacgcgacactggaactgaaagaggtagtagggtccgtcagcgaggctggtcgcaactcacaacccacccggtcctcggctcaggaagtcctcgcctcatagcaccccgccggccctggactctttcccacgtcgcacctcgcacctgctggtctaaccctgcaggggtgcttccggcagagctgtgctgggctctggtgaagagctcgggatacatggccccgcgtccaccttctcaccctcctctagctctctgccaccgctgccgctgccaccacctcccccatcacaagactacagtgcccatagggcctcttaccctcctcacgccctgtttcttgtcgtcaccttggagcatcctcgctgctacagaaggaaactgaccccagcagggagccgccggctagcagattcagaccatgccgctcacctctcacagtgacattcagcagcgtgctctgaacggggccgtagctgttgtctgctgtacagtagtatcctcctgcatggctctacctgatggcagggggctccgactctgctcttggggaaggctgagttttcctccccagactctcctgcgtgtcctttcggtgccaggagaacgtggtttcccctgtgccttcagccacggagcagacaaggaccagcgtctccccttcaaccgcctggccccctgagggctgggtctccaggagcaccccagacacagggatccctatgtaaaaatgagaccacagggaggggccagctgtgaaggagggcagggctgggtggaagccagtatcacctgctgggcattaaggcaagtggggttggtggaactaaatgtttgggtagagggtccacctcacttgcctgagtgtttttaatagcgagagagcacgctgaggaacattacacgggaccaccttgctgtttgatgctccataacaatcctaccctgcacttcctccacattcttttgccctctggaatgaccgcagcccacagaaatctcatcatctcctgatctccagatgtacatgggcagcaggagtggtaggaagagcatgggttagggggatggactcagttactatctctggatctcaatcttgctaaatcaattgctatttctggttctcagttttctcaagtataaaatgtgaataatcatgtctaccttacagagttctcatggagatgaaatgcgatacaagtacccctcactttggagaggttcagtaaatggtagctattattggtaccactcttcactggcacagttgagattggaagtgtagcaaggtggttaaaagcacataccctggagcctgagtgaccaggttcatattccagctctatgtgttgagttaccttgggcaagccacttaacagctcgatgctttctctttcctcatctgtaaaatggagataataatactacctactttacaggtgctatttgtagtactgtatcatagggttgctactaggactaaatgttaaactgctctgaacagtgtcatgtacagctgtaaacattccttaaatcttctcctctccagatatttatgagtatcaaaggggttattccagaactgagaataacagcttgggttcagacctggcatttaagcctttggaaaaatgtttgtcattctgctaaaaagcctaaccccaaggcctgaaccttcaatcattaacttcagtgtaatgaaagacagtgtcatacatgggggaagaatggaatacagaaaaagggcatgaaagttgtttagattgtcttcccagcctatccctctagccatgagaccatggaggaggggtagctcccagggtcctgtctcagaagagaggccatcctctcaccagatctacatccacagtcctcaaaatgggatccataaggaagtggggagaaggcattgagaacttccagattatattaaacactttttaacctt

SEQ ID NO: 1521 - DNA, 1516 bp, Homo sapiens
agagataccactgagtccagaagcaagacctgtgagagtgcacagtgccacttcgccccatggctgaagatggtttgcccaaaatttattctcatcctccaacagaaagcagtaaaacaccaactgcagcaaccattttctttggggctgacaatgctattcccaaatcagaaacaactattacttcagaaggagaccacgtcacttcagtaaatgaatatatgctagaaagcgatttttcaacaactacagacaacaaactgacagctaaaaaggaaaaactcaaatcagaagatgatatggggaccgactttattaagtcaacaactcacctacagaaagaaattacctctctgactggcactacaaactccataacaagagactctattaccgaacatttcatgccagtgaaaattgggaatatttcatcaccagttactactgtttctttaatagatttttccactgacatagcaaaagaagatatcctcttagctaccattgacacaggagatgcagagatctcaataacctctgaagtctctggcacactaaaggacagcagtgctggtgttgctgacgctcctgcctttccacgtaaaaaggatgaagctgatatgagcaattataattcctccatcaaatccaatgtccctgctgatgaggctgtccaggtcactgattccattattcctgaggctgaaatccctcctgctcctgaagaaagcttcactactattccagacataactgcccttgaagaagagaaaataaccgaaattgacctaagtgttttagaagatgacaccagtgctgtggctacattaactgactctgatgagaagtttatcactgtgtttgaactcactacctctgctgaaaaagacaaagataaacgggaagatactctgctaactgatgaagaaactaccgagggagccagtatttggatggagagagatactgcaaatgaagcagagacccattctgttttgcttactgctgttgaatccagatatgacttcgttgtccctgcatcaatagctacaaacctagtggaagaatcatctacagaagaagatttgtctgaaactgataatacagagactgtacctaagatcactgagccattttctggaactacctctgtattagataccccagactataaggaagacacctccacaactgaaacggatatctttgaactactgaaagaagaacccgatgagttcatgatttaaaagcaacaaaagggataccatgtagaattgtgcattagtctagccagctagccttaacatctaagaaatttttccaacaagcaaaaacctttagaaatgaaagaatgtgggcatttaaggtcttaaacactgaatatcacactcttcttatgactcttgttagcgattcaaggacataaatcttcattcttttctggcacagactacttaaatgggtctgttttcactttgctcatttttcttcaataaatctttttggcaagcaactg

SEQ ID NO: 1522 - DNA, 3030 bp, Homo sapiens
gagccaatgaaagctcggaccagtggcaagtccgagctgtcattgagaggcgggacttccggcgccgccattgcggtcctcattttgctgctggtgggttgggctacagcaggcctctggagccacaccagggcacgggagtgggtgcagggaccgtcaccgcgccttcacacgcaccatagtgcccggctaattactctgcttttatgagccaaggtgttcccgaaagtggagccagcgccacgcgtctccagggtctccatacccagccttcgtccctgcggtgcccagaggccttgcgcgcattttgcatttgggaagacaggtcctgagtgcgaccgtcacccagcggaagtgtgagggttcggcccagcggcagggctagccctgggcctcctgttatggccctgcccagcccacaggttctaatggggttgccagcgttgctgatgggcccggcgcagcatacttcttggccctgtggctcagctgtccccacattgaagagcatggtaacctttgaagatgtggctgtatacttctcccaagaggagtgggagctccttgatgcagcccagaggcacctgtaccacagtgtgatgctggaaaaccttgagcttgtgacctcacttggttcttggcatggagtagagggtgagggggcccatcccaagcagaatgtttctgtagaagtgttacaggtcaggatccctaatgcagatccttccaccaagaaagctaactcctgtgacatgtgtgggccattcttgaaagacattttgcacctggctgagcatcagggaacacagtctgaggagaaaccctacacatgtggagcatgtgggagagacttttggttgaatgcaaaccttcaccagcaccagaaggagcacagtggagggaagccctttagatggtacaaggacagggacgcacttatgaagagctctaaagtccacctgtcagagaaccccttcacttgcagggaaggtgggaaggtcatcctgggcagctgtgacctcctccagcttcaagctgttgacagtgggcagaagccatattccaatcttgggcagcttccagaagtctgtaccacacagaaactcttcgagtgcagcaactgtggaaaagccttcctgaagagctccactctccccaaccatctgagaactcactctgaagagataccatttacatgcccaacaggtggaaatttcttagaggagaaatcaatccttggtaataaaaaatttcacactggggaaatatcccatgtgtgtaaggagtgtgggaaggcctttagtcactcatctaagctgaggaagcaccagaaatttcacactgaagtaaaatattatgagtgcattgcatgtgggaaaaccttcaaccacaaactcacatttgttcatcatcagagaattcactcaggagaaagaccttatgagtgtgatgaatgtgggaaagccttcagtaacagatcacacctcattcggcatgagaaagttcacactggagaaaggccttttgagtgcctgaaatgtggaagagccttcagccaaagctccaatttccttcggcatcagaaagttcacacacaggtaagaccttatgagtgcagtcaatgtggtaaatccttcagccgaagctctgctctcattcagcactggagagttcacactggagaaagaccgtatgaatgcagtgaatgtggaagagcttttaacaataactccaaccttgctcagcaccagaaagttcacaccggagaacggccttttgagtgcagtgaatgtggaagagacttcagccaaagctcccatctccttcgacatcagaaagttcacactggagaacggccttttgaatgctgtgattgtggtaaagccttcagtaatagctccaccctcatccagcaccagaaagtacatactgggcaaaggccttatgagtgcagcgaatgtaggaaatccttcagccgcagctccagcctgattcagcactggagaattcacactggagaaaagccttacgagtgtagtgagtgtgggaaagcctttgctcacagctccactctcattgaacactggagagttcacacaaaagaaaggccttatgagtgcaatgaatgtgggaagttctttagccaaaactccattctcattaagcatcagaaagttcatactggagaaaagccttataaatgcagtgaatgtgggaaattctttagccgaaaatccagccttatttgtcactggagagttcacactggagaaaggccttacgaatgcagtgaatgtgggagagcctttagcagtaactcccacctggttcgtcatcagagagttcacacacaagaaaggccctatgagtgcatccagtgtggaaaagcctttagtgaaagatctacacttgttcggcaccagaaagttcacaccagagaaaggacttatgagtgtagccagtgtgggaaactcttcagccatctttgtaaccttgcacagcataaaaagattcatacctgagtggagccttatggaagtggtctttgtgagaaaatcttcagccaagtcaaacttcatgcagcagaatccccataccagaaaaattacctacatgtactgctaatgtggaaaagccttcagaagctactctgtttctgaccagcccaggaacctttgcagggccatctcacccatgcagcataaggcagaagccatagtcactttccatcttgcctggatccaaaaatttgcagcagtcctgtcctcatgcatggggaaaacagtaccctgagccttccttcctgtgttctctagggattcaggactgtgctcagctgaaccgatgctggttgaggggccttgagggaaatctaatttgagctcaggaagatgcacattccttgtggatgtggtcaagtctgtgtttaacccctaagatgtgtccattgaggccacaaatcaccctccactggaatcacctaccttgcctgcactaactggtgataataaagaccttattgatcaggtc

SEQ ID NO: 1523 - DNA, 1844 bp, Homo sapiens
agccacccaagctgctgtgtgcaggaaggtgtgtgggccaggacggggctgcacaggcctggcactgccctccaggacagggtcactcagtgtgggatgctgtcagaatgcctctcggggcggggactccagtcaatgtacaaagacgtgaagactcagccacagaaggcagccacaggctcatcttggcagccaacagggatgaattctacagccgaccctccaagttagctgacttctgggggaacaacaacgagatcctcagtgggctggacatggaggaaggcaaggaaggaggcacatggctgggcatcagcacacgtggcaagctggcagcactcaccaactacctgcagccgcagctggactggcaggcccgagggcgaggtgaacttgtcacccactttctgaccactgacgtggacagcttgtcctacctgaagaaggtctctatggagggccatctgtacaatggcttcaacctcatagcagccgacctgagcacagcaaagggagacgtcatttgctactatgggaaccgaggggagcctgatcctatcgttttgacgccaggcacctacgggctgagcaacgcgctgctggagactccctggaggaagctgtgctttgggaagcagctcttcctggaggctgtggaacggagccaggcgctgcccaaggatgtgctcaacaatgaagaggcgcagctgccagacccggccatcgaggaccagggtggggagtacgtgcagcccatgctgagcaagtacgcggctgtgtgcgtgcgctgccctggctacggcaccagaaccaacactatcatcctggtagatgcggacggccacgtgaccttcactgagcgtagcatgatggacaaggacctctcccactgggagaccagaacctatgagttcacactgcagagctaaccccacctctgggcctggccagtgggctcctggggggccctgccttgaggggcactgtggacaggaaaccttcctttgccatactgcattgcactgcccgtggcttggccagcatcccccggatcagggccctgtggtttgcgtgttacccatctgtgtccccatgcccagttcagggtctgcctttatgccagtgaggagcagcagagtctgatactaggtctaggaccggccgaggtataccatgaacatgtggatacacctgagcccactcttgcacatgtacacaggcactcacatggcacacacatacactcctgcgtgtgcacaagcacacacatgcaagccatatacatggacaccgacacaggcacatgtacgtgcacaggtgtgctacacatgtgcacacatgcacagttgcacagacacacacacacaggtgcacacacacgatgccgaacaaggcagaagggcgactctcacctctcatgtgcttctggccagtaggtctttgttctggtccaacgacaggagtaggcttgtatttaaaagcggcccctcctctcctgtggccacagaacacaggcgtgcttggactcttgacaagcagacctgctcctgcagaggagacagccacatttggaattgggcaccgagaagacctgagaaaaacccactctctctttttttttttttttaagactgtctcagaaagataaaggagtgaatatttacactttttggtttcatggcagtttccagatttttttgaatcccaaagaatcttctgggttcagatactgagaacgtttgatgcttgggaattgatggtcttcaagatagcagactccagttaagcattgtgctttcttcatgttaagttttagcacaaataaaggcagagtttcctctcag

SEQ ID NO: 1524 - DNA, 1924 bp, Homo sapiens
gttattgcgactttgatctaaacagctctgtaaagcccattttcacatttttaaaataatatgctttagcagcaggtgaggaaaacttaaggcatggcacatttattggaaaagcagcagtgggcggcttggtttaatggcaacaccactagataactgtctaaggccctttccagatccaatggtcaaggtaacagcagaaacaaagaaaatctcagaggtctcttcttatgtctctgctaacaataaaaagaacagcttttggggaagtgggctgctttatcctgtagccctcctcagatgccaagactgctgggctggccaccagactcacgtcctcagtaaggaatttacctcctacttttcttcgggggcaggtagggaagcacagcaccagccctcagctgtcttgggctccctgatctggttaaggagagtgtatttactcagggccatggtggtgcatggaggaagccaaccctgtcagcgctggctggtcatcagaatggaagtgggaggacatccttcatttccaggtcatgcctggttaacatttcaccttaactgaggggccaaagagaggctacgcagcctggatcagagctccgacagcccttacctggtggcttgttcgtggaatttatcacatcctgttgtaacgctctgtttacatctctgctgcccagccagactccgccttctgtgattttctcatcccaccacccagtactgtacatgctcaatggatgactataaacaagtgaacagacagcaggagtggctgcccttatgcccatggaactgggcctctcaattcagctcatgttggtcatttcagatcatctgaatgtaaagggtcctctctgtctctgaccaggcttcttgcaggcctttggcagccgtggagctctgagagagactggtttcctgagggctgggcaccccggtctatttattgggaggccacaaacagaaagagtgggcatcaggaccaacgggcacatggccaccacccagatacgtgactctggcatgtatttcacttctctggggccagatggcctcttcctaagattctcctcagtgctgagagttcttcagtcctgcctgctgacttccctccaggacagaacagatgcctcttcctcccatagatatgatgcaagaactgagctgtccaagcaaaaaaaaacctttgaaggaagaatttctgtgctgtgagtggtttactctgagaataggactcaagttttagaaatctttgttcaatgtcagagatagagcgactgtaatctgtgagccaagaaaaaaggtttgtaaaggctagaagaaaagaagcccatggctaagaacttgtaaaaacatctacagcaaacaagagttccaagagaaagactgtgaaacagcaggcccacaggagctggagagcgagctttgaaacgatacaaaattaattgtctaaggggcaaataaatggtgcagtacacaaatgcaggaggtgacacaaacgcgcctggattcaacagaggacaagtagacacatctatgtcccaggctgcactaatgaggaaagtccaccaggtgggaagtaggtaccactgagagtttataaggctaaaaaccccagtcttgggatgcggagaaggagggaaggaagtgagaatgaacaggaatggcatattctgttcacttcactgacagctttgcactgtgcattcccagctgggcatgtcccagacatgatctcttgcatgggctgtactaacgaacatcaaatattcaggctggcaaccagttacatgaaccggtgtcaggagtgcacattaataggcatctgactagggcagggctgggcaaactacggcccctgcgctacatccagcctaaagcctgtttctgtaaataaagttttatcaaaacaccc

SEQ ID NO: 1525 - DNA, 1753 bp, Homo sapiens
aaagttgctatgtcattttgcatttccaccagcaatatatgatagttcgtttatttcacatctttgacagcatttagtgttgtcagggttttttttgtttgttttagacattttagtagtctggctcttgctgattgaattcctttggtgcagtttagcatgttcctctgtgtcctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgcgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggtatacatcaagagctggtgaatgcagcacgtatgtgggctctcacgcaaacgtgccttcttagtggagggcccagacttactacttacaactgatcatagaaagagcatccccccggtccttcagaatccaaacacgctttccgtcctaccaacgcagccgccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttcttt

SEQ ID NO: 1526 - DNA, 1812 bp, Homo sapiens
agcttcaggggcggcccagggcagtgttgctgcatattgcatggatgaaaggctgaaggctgcctcctcttgcaggctggcttctgagattgcaccttcttctcctgctactcctccaaatctatgacccttcaaggcagagctgacctgtccggtaatcaaggcaatgcagccggccgcctagctacagttcacgagccagttgtcacccagtgggcggtgcatcctccagcccccgctcaccccagtctcccggacaaaatggagaaagcgcctccacagccccagcacgagggcctcaagtccaaggagcatcttccgcaacagcctgccgaaggcaagacggcgtcccgccgcgtcccacgcctccgggctgtggtcgagagccaggccttcaagaacatcctggtagacgagatggacatgatgcacgcccgtgcagccacgctcatccaagccaactggaggggctattggctccggcagaagctgatttcccagatgatggcggccaaggccatccaggaggcctggcggcgcttcaacaagagacacatccttcactccagcaagtcgttggtaaagaaaacgagggcggaggagggggacataccttatcacgccccacagcaggtgcgcttccagcatccggaagagaaccgccttctgtccccgcccatcatggtgaacaaggagacccagttcccttcctgtgacaatctggtcctctgcagaccccagtcgtcccccctcctgcagcccccagcagctcagggtaccccagagccctgtgtgcagggtcctcatgctgccagagtccggggggtggccttcctgccacaccagacggtcaccatcagatttccctgcccagtgagtctggacgcaaaatgccagccatgcctgctgaccagaaccatcagaagcacctgcctcgtccacatagagggtgactcagtgaagaccaaacgtgtaactgcccggaccaacaaagccagggctccggagacaccattgtccagaaggtatgaccaggcagttacgagaccatccagagcccaaacccagggccctgtgaaagcagagacccccaaagcccccttccagatatgtccagggcccatgatcaccaagactctactccagacatatccagtggtctccgtgaccctgccacagacatatccagcgtccacgacgaccaccaccccacccaagactagcccagttcccaaagtaacaataatcaagaccccagcccaggtgtatccggggcccacagtgaccaaaactgcacctcacacatgccccatgcccacaatgaccaagatccaggtacaccccacagcctccagaactggcaccccacggcagacatgccctgcgaccatcacggcaaagaaccgacctcaggtttcccttctggcttccatcatgaagagcccgcccagcgtggtgatgctagtgggctccagccctcgcacctgtcatacctgtggacgcacacagcccacccgtgtggtgcagggcatgggccagggcactgagggccccggggcagtgtcttgggcctccgcctaccagctggctgccctgagtcccaggcagccgcatcgccaggacaaagcggccacagccatccagtccgcctggaggggctttaagatccgccagcagatgaggcagcagcaaatggcagcgaagatagttcaagccacctggcatctaggaccctggctccctgcagtggggacttcgtgggaggcactcatggctctctgggtctaatgaataaagtcctccacagcctag

SEQ ID NO: 1527 - DNA, 1853 bp, Homo sapiens
aatcgccagggtatctatggccgggctcaggcggctgctggggagccaggagaccgcgcgggacggcggatgaggcgcggcggctgcggcccagggcacctcccctctggcttcccgaacccggccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaacacaaacacgtgtgatcaaaatctaaaccattgccttgaactcattgagcaagttgccaaggtgcagggacaactctttgggatcctcacagcagcagcccaagaaggaggacgtaatgatggtgtggaaacaatcaagtcacgccttttgccttggctggaggcttcctttactgctgcttccctgggaaaatctgttgacagcaaggtcccctctctgcaggacacgtttgatagggagagacataaagatcccagtcctcgggatcgggatatgcaacagttagactctaatttgaactcaacccggagtcaatgcaaccaggttcaagacgatctggttgaaactgaaaagaatcttgaagaaagcaagaacagatcggccatatcccttttggctgcagaggaggaaataaatcagctgaaaaagcagcttaaatctcttcaagctcaggaggatgcccgccacagaaacacagatcagaggagctcagagaataggcggtcagagccttggagcttggaggagcggaagcgtgagcagtggaactcactcaagcagaatgcagaccagcaggacacagaagccatgcccgattataagaaacagctccgaaacctgaaggaggagatagctgttctgtctgctgagaaaagtgcactccaaggaaggtcctccaggagccggtctcccagccctgcccctcgcagccgtagctgcagccgcagcagatctgccagcccctccaccgctgtcaaggtcaggagaccgtccccaaaccgctccaagctgtccaatgtggcgcgcaaggctgccctcttgtcccggttcagcgattcctattcccaggcccgcctggacgcgcagtgcctgctgcggcgctgcatcgacaaggctgagaccgttcagcggatcatctacatcgccacagtggaggcattccatgtagcaaaaatggcattcagacacttcaagatccatgtgagaaaatcgttgacaccatcttatgtggggtcgaatgactttgagaatgctgtcttggattatgtcatttgtcatcttgatctatatgattctcaaagcagtgtcaatgatgtgatccgagccatgaatgtcaatcccaagatttcattccctcctgtcgttgacttttgccttctcagtgacttcatccaggagatatgttgcattgcctttgcaatgcaggccttagaaccacccctagatattgcatatggagcagatggagaagtttttaatgattgcaaataccgccgcagctacgactcggatttcactgctcccttagtcctctatcacgtgtggcctgctctcatggagaatgactgtgtcattatgaagggagaagctgtcaccaggagaggggcttttgtacggtggccttgcatagtgacaattcatcccaagtgtttgattcacaagttcgagaacatttataaacccagagattctataaaag

SEQ ID NO: 1528 - DNA, 1926 bp, Homo sapiens
ttaagcccgcggggcagggcgaggggcgggcgtcggggacattaccggacaggccttgtccggcaataccaagtttcatgcaggctcttgggaaagctggtgctgctgctgcctgattcccgccgacagaccttgggaccggggccaacactggcagctggagatggcggacacgagatccgtgcacgagactaggtttgaggcggccgtgaaggtgatccagagtttgccgaagaatggttcattccagccaacaaatgaaatgatgcttaaattttatagcttctataagcaggcaactgaaggaccctgtaaactttcaaggcctggattttgggatcctattggaagatataaatgggatgcttggagttcactgggtgatatgaccaaagaggaagccatgattgcatatgttgaagaaatgaaaaagattattgaaactatgccaatgactgagaaagttgaagaattgctgcgtgtcataggtccattttatgaaattgtcgaggacaaaaagagtggcaggagttctgatataacctcagatcttggtaatgttctcacttctactccgaacgccaaaaccgttaatggtaaagctgaaagcagtgacagtggagccgagtctgaggaagaagaggcccaagaagaagtgaaaggagcagaacaaagtgataatgataagaaaatgatgaagaagtcagcagaccataagaatttggaagtcattgtcactaatggctatgataaagatggctttgttcaggatatacagaatgacattcatgccagttcttccctgaatggcagaagcactgaagaagtaaagcccattgatgaaaacttggggcaaactggaaaatctgctgtttgcattcaccaagatataaatgatgatcatgttgaagatgttacaggaattcagcatttgacaagcgattcagacagtgaagtttactgtgattctatggaacaatttggacaagaagagtctttagacagctttacgtccaacaatggaccatttcagtattacttgggtggtcattccagtcaacccatggaaaattctggatttcgtgaagatattcaagtacctcctggaaatggcaacattgggaatatgcaggtggttgcagttgaaggaaaaggtgaagtcaagcatggaggagaagatggcaggaataacagcggagcaccacaccgggagaagcgaggcggagaaactgacgaattctctaatgttagaagaggaagaggacataggatgcaacacttgagcgaaggaaccaagggccggcaggtgggaagtggaggtgatggggagcgctggggctccgacagagggtcccgaggcagcctcaatgagcagatcgccctcgtgctgatgagactgcaggaggacatgcagaatgtccttcagagactgcagaaactggaaacgctgactgctttgcaggcaaaatcatcaacatcaacattgcagactgctcctcagcccacctcacagagaccatcttggtggcccttcgagatgtctcctggtgtgctaacgtttgccatcatatggccttttattgcacagtggttggtgtatttatactatcaaagaaggagaagaaaactgaactgaggaaaatggtgttttcctcaagaagactactggaactggatgacctcagaatgaactggattgtggtgttcacaagaaaatcttagtttgtgatgattacattgctttttgttgtccagtagtttagtttgtgtacatatatacacatatatattttgcactacacaaacgataacattttaaggactaatattgctgatacttgaataatcaatctctactaggttataagtagtatacacagatttaccctgcccttgaacttgaaggacattaaattattaatgatc

SEQ ID NO: 1529 - DNA, 1955 bp, Homo sapiens
agaggggcgggacttctccgggtcaaggccaggtctcttccctgctcggtgctatgttcctgttccacggggtggcgggtcctggaagggagaagcccagacccagtggacactgacattgtctctcgctgttcccagccttttccaggcgtgtgacttaatccgtttccacagccagaccttttctccgtgagttcctcagccaggactgctgccatgccggtgactgttacccacccaaccgtcacgaccaccatgcggtcccccaccgtcgtagggtcctctagggccctgatccagcccctgggcctcctccgcctgctgcagctggtgtccacctgcgtggccttgtcactggtggccagcgtgggcgcctggaaggggcctatgggtaactggtccatgttcacctagtgtttctgctttgccatgaccctggtcatcctcctcgtggagctgggcggctcccaggcccgcttccccttgttttggcgcaacttccccatcacctttgcctgctatgcggccctcttgtgcctctcggcctccatcatctaccccaccacctacttgcagttcctgtcccacggccgttcccgcgaccacgccatcgccgccatcgtcttctctggcatcgcctgtgtggcttatgccaccgaagtaacctggactcgggcccggcccggcgagatcactgactacatggcctccgagctggggctgctgaaggtgctggagaccttcgtggcctgcctcatcttcgtgttcatcaatagcccctacgtgtaccacaaccggccggccctggagtggtgcgtggcggtgtacgccctctgcttcgtcctggcggccctcactgtcctgctgagcctggggcactgcaccaacatgctgcccatccgcttccccagtttcctgttggggctggccttgctgtccgtcctcctctatgccactgcccttgtcctctggcccctctaccagttcaacgagaagtatggtgtccagccctggcagacgagagatgtgagctgcagcgacagaaacccctaccttgtgtgtatctgggaccgccgactggctgtgaccaacctgacggccgtcaacttgctggcctatgtgggcgacctggtgtactctgcccacctggtttttgtcaaggtctaagactcccaaagggccccgtttgcctctccaacctcttcatcctgccccccctgagttttctttattgagtattcatttcctgtgttttcctcttccctatctcccctcctccccttttctttccttcccaattcatcgcactttcccagttctctgatgtatgttcttccctttcctctgctgtttccttcttgttttgttctgttgcccacaacctgttttcacccgtttctctttttccactctctcttttgtttctttcctctcaattcttttctaggtttcctgttggttttcttatctgcctatttcccgaccatcttctcctatttcctggggagccctgaggcttttcttctcctgcccccacgcacctccagcggtgatgagctccacacccccacacccattgcagctgtggcgccacgtcctcccaaggggccttctgcccgcccccgccctagccctagctgtgccttagtcagtgtgtacttgtgtgtgtttgggggagtgggaattgggccccctttctcccagtggaggaaggtgtgctgtgcacctcccctttaaattaaaaaaaatgtatgtatctctggaggtcaataatttccagtgagcgggaggcttcaagcgcagaccctgggtccctagacctcgcctagcactctgccttgccagagattggctccagaatttgtgccagacttacagaaaacccactgcctagaggccatcttaaaggaagcaatggatggatccctttcatcccaactgttcttcgcggtatc

SEQ ID NO: 1530 - DNA, 1727 bp, Homo sapiens
cacagaggctacctgggcacggaccccgcagcttcctggggcccagtcagccgctccaggtgcttaagtctggactgcggaggccggggcggtggcgtgcagggtgaggtctcccgggctggcgcgcgtgcaagccccctgctgctacctcgcgctaggccagctccaggagggcaacagacgacaggacattgcaaaagggccacttaaattttctttcgagtaaacagaacacctgccaagacactcgagcctgggcgtgccccaagacaggtggttggggtctaggagtcggctgcagctggcgatgctctgaggggacgtcagggcctcaggatcgcccctatgaagacgaagtgcatctgtgaactgtgctcctgcgggcggcatcactgtccacatctccctaccaagatttatgatgaaacagagaaaccatgtcttctctccgaatataccgagaactaccctttctatcactcctacctgcccagagagtccttcaagccaaggcgggagtaccagaaagggtctataccaatggaaggcctgactacatcaagctgattatttgccttggaaccaaccaaggcgagagccacttcgtctggaacacaaataccagccggcatcagtcaggtttgataacagaaccacacaccaggacgattaccccataaaaggccttgtgaagaccataagctgtaaacctctggccatgccaaagctctgtaacatccccttggaggatgtgactaactacaagatgagctatgtggcccaccccgtggagaagcgctttgtgcatgaagcagagaagttcaggccctgtgaaatcccctttgaaagccttaccactcaaaaacaatcctaccggggcctgatgggggagcctgccaagagcttgaaacctctagccaggtctcctgggctagacatgcctttctgtaacaccactgagtttcgagataagtaccaagcttggccaatgccccggatgttctccaaagctcccatcacctacgtccctcccgaagacaggatggatcttctgacaacagtgcaggcccattacacatgccctaagggtgccccagctcagtcctgccgacctgcacttcagattaagaagtgcggtcgctttgaaggctcttccaccaccaaggatgactacaagcagtggtccagcatgcgcacagagccagtcaagcccgttccccagctggacttgcccaccgagcccctggactgcctgaccaccactcgggcccactatgtgccccacctgcctatcaataccaaaagctgtaagcctcattggtctggccctcgaggaaatgtccctgtggaaagccagaccacctacaccatcagctttactcccaaggaaatgggcaggtgcctagcttcatatcctgagcctcctggctacacctttgaggaagtggatgctttgggtcacaggatatacaaaccagtttcccaggcaggctctcagcagagcagccatctttctgtagatgattcagaaaaccccaaccagagggagttggaagtgttagcctgattttgaaaaatagtaatttagaaattacacagtacttttaaaagcagacaactgagaattatttgttggacaaaaaagaattccctaaaatgacaaaaaacaaaaaacaaaaaaccttcaccacttccagagcacttgaataaaatgagaatcacttgac

SEQ ID NO: 1531 - DNA, 2087 bp, Homo sapiens
ttgaatacttcaatgaggagcacaggcaccagctctgacgggagtgactgagggagctcctggtgaaatgtgccaaggttgctgcagttggagagggggctccaccagctccacatcctgggcagacaggaacacagtctctttctgtatcacacccttgtgccagggctgatgactctcagttcaggcagacactgtcatctaacgccaggccacaatgtcaccgaaagccagggaaaacacctgtcccgtgattcttcactggaatggcttcagcatggaatctcttccctcagctcaatacagacaactttgtggctctcctgttctccagtgtaggaacactgctgcttcatagagagagggggaatggttctgccttacagtacatgcaggtgggagtcctctgtggtggtgtcaggtgattggattagttcaacctcagaccccagagggaatgaacaggtgccatcactgggctaggcaatcccctaatcctcaggttcctaaatggctctctggacaatgtgcatgagtcctggagggactaaaccaggaccggaccagcaaacatgtcttcaaattcccacagttcaggtattggctgtgataggaaggggtgggctggcccccaggctgctggcagaatgctttggaaagggcaggcagaccactcaggcagctgcggaatattccatcagcatgagcagtggaggcaggcagctacaaggtgcatggcccactcatacctccctctggcataaacagtggtggatctggtcattgtggcacatgcaggtgctggtctccctgttccctccctacaactgctgctaataagatgaaagcaggagccccagggcagaatgcaggcctctgagggctaggctttcaaaagggtgctaggcaacagcaaaatgcacaggcaggggtagccctgctcagtgagagcagtgaaagctaacagctgtggggcctttggcccactcacaccttcctcccacagaaacagtggtggtatccaccactgaggtgtgcaaaggtgtcctgtcttcccactccctccttggcctggcagtggtggtggcagttgcagcaacagcagcaggatccccagggcagactgcaggcctctgggggctgggctctcagaagggtgccaggccacagccaaaatgctcaggcagaagcaaggtggctgtactgtgagcctagggaaggcaggtcccccttagcgggaacagtgaaagcaagggtgctcaatgtgcttgctcctctaccctgcagcagcagcagccgtgatacacatctttggggtgtgcaaaagtacttggcctccccactccctccccactccctcctggcactgcaacagcagctggtaccaggctgcagcgtttcaggaatgaaaagcctgtggaattccatgtgggccgaagcagtgcctctgcgcaatctccgggcaagttccctgtgttagactggaggccccggggggttcagggagctctcccatcgctaggattgtgaaaatccacactgggagtggggccccaggggttgctcactcagcccttccccatgtcagggagctactcctggctccataccaatcccagctcagcaggctgcatggcttcacctttctttgctttccataattcccatcacttctctgatgaattccgttgtgctctctcttttagatgatctattcaaagtgtgaatatttactattttgattcatctccatggaagaggaacccactagctgcttctagtcagccatcttgaaccagaagcccttattttacttttatttgtactttttctttcaaaaaactttttaaatatgtcattaaaatggtaaatttgcaagtttaagtgaaatctagtttagaattgatgaattgttagtgatgatattcacatcatgaaagtactcaatagcaactagccaaagacattactttgaggcatgaaaatatcctgtgtctgtttctgcaatatatgtttatttcaggataaaaaaagaaattgtttctataatggattttcacatggaacaagtaaaatgttcttgactg

SEQ ID NO: 1532 - DNA, 1812 bp, Homo sapiens
aatcctcacattttgggagggaggccaaggcgggcagatcacctgaggttaggagttcaagatcagcctggccaacatggtgaaaccctgtctctattaaaaataccaaaattagctgggcatggtggcacgcgcctgtaataccagctactcaggaggctgaggcaggagagtcacttgaacccgggaggcggaggctgcagtgagtcgagatcgtgccactgcactccagcctgggcgacaagagcgagactctgtctcaaaaaaaaaagagtggttaacaagcatgatgatacaaccagttgaaagcaatatttgagttcataaagaagttgatgagttgataaaccaacaacacctaattggggaaagcataaggaagagagctgtgttgcaatcaaaaggttttttttttttacttgaatgtaaataccaatcaagatacattgaaataaggacctgaaggtggcaagacagtagaaagcaggagtaagagtggaaatgaaagcagaaggtcctacagtgtaggggaagcaatggaagaacttctacctgatggacaaatatgggctaatatggatccagaagaacgaatgttggcagctgctacagcttttacccacatctgtgcagggcagggtgaaggagatgtcaggagagaagcccaatctatccaatatgatccctacagtaaagcttcagtagccccagggaagcgacctgctcttcctgtgcaactacagtacccacatgtagaaagtaatgtcccttcagaaacagtctctgaggcctcccaaagactccgaaagccagtgatgaagagaaaggtgctgcgcagaaagccagatggggaagtattagtaacagatgagtcgattatcagtgaatcagaatctggtacagaaaatgatcaggatctctgggacttaagacaaaggctgatgaatgtacagttccaggaagacaaggaatcttcatttgatgtttcacaaaaatttaacctaccacatgaataccaaggaatttctcaagatcagctcatttgctctctacaaagagaaggaatgggctctccagcttacgaacaagacctgattgttgccagcagacccaagtcctttattctcccaaagctggaccagttaagccgaaaccggggcaagacagaccgggtagcccggtattttgagtacaaacgggactgggactcaatacgtttacctggtgaagatcatagaaaggaattacgctggggtgtccgagagcagatgctttgtcgagcagaaccccaatccaaacctcagcatatatatgtcccaaacaattatctagtaccaacagagaagaaaaggtctgcactccgttggggtgttcgttgtgaccttgcaaatggtgtcatacccaggaagcttcccttccctctttctccttcttaaatctttttaaacttctttcacaggattgtttgagataacctagctctttatatcttcccttttaaatagaaacaactgtcttgagaagctcttcgaaacattttatggtaaggacttcacctatcattggtctttcctagctatatatcacattggtatcagatgatacttccaaattgccactcaaatccagcaattgcaagataaatcatatcagagaaagaacaacagacctggtctttctattttgtcaaattagtacgggccctttgtgtcctgtaactttttttacctatcaatatgagttgctgtgcttcagtgtgtgttttttaagttgctgggcattacacttaccaattaaagaattttggaaatt

SEQ ID NO: 1533 - DNA, 1933 bp, Homo sapiens
attgaataacatcatggaatcagaatacttgaactggaagagatcatataatatatagtctagtagtttttctgtttgctccgtggttggggcagggaggggaggaggaggagcttggcaagttatcttctccttccgtgaaacagagcactttaaagtgcttactttctttatcacttactttctcatattggccttccaggtatatgctcgtatgtcagaagtcttaggaataacagatgacaaccacgttctagagacgttcatgacaaaaatagtgaacacttcccttttcttggcatcagtgacaatcatagtctcagcgacttcaggtgtcgaacaaccttctacacagcgctcactcgccttctgatggtagatctgggtgaagatgaggatgaatttgagaatttcatgctgcctcttacagttgcttttgaaacagtattacaaatattcaacaacaactttaaacaagaagatgtaaagcgtatgttgatcgggctggcaagagatcttcaagggattgcctttgcactgaacacaaagaccagctacaccatgctgtttgactggatgtacccaacgtaccttccccttcttcagaatgctgttgaacggtggtatggagagccaacatgtacaactcccatcttgaaacttatggcagaacttatgcaaaacagatcccagcgtttgaattttgatgtatcatctcctaatggaattcttctcttcagagaagctagtaaaatggtttgcacttatggtaatcagatcctgtcccttgggagcctctcaaaagatcagatttatccaatgaaactcaagggcatctccatctgctattcagctctcaagtctgccttgtgtggaaattatgtcagccttggcgtcttcaagttgtatggggacaaccattttgacaatgtactccaggcttttgtcaaaatgctgctgtcagtgtcccacagtgacttgctacaataccggaaactgagccagtcttattatccactcctggaatgtctcactcaggaccatatgagcttcatcatcaacttagagcctcctgtactcatgtatgttctcacatctatctcagagggactcactactcttgatacagttgtctcctccagctgctgtaccagtttagactacatcgtcacctacctcttcaagcacatagcaaaagagggcaagaagccacttcgatgcagagaggctacccaggctggtcagagactattacattttatgcagcaaaacccagatgtcctgcagcagatgatgtctgtcctcatgaacaccattgtctttgaagactgtcggaaccagtggtcagtatccaggcctctcctggggctcatcctgctcaatgagaagtatttcagtgaactgagagcaagtttgataaacagccagcccctccccaagcaggaggtccttgcccagtgcttcagaaacctaatggaaggagtggagcagaacctgtccgtcaagaacagagacaggttcacccaaaatctgtctgtattcagaagagatgtggcagaggcgttgcgcagtgatggcaacactgaaccatgcagtctcgacatgatgagctgacccgacttttctgaccatgtgcggagcagcctttatcaagagactcctgaaggtctgggtctcaggacagtgatgttggctagcccaggggaatgtatttttcaaaacatacaagcaacagcaaaagccctaacttcttatacgtctagcctaattataagaatttctaacagtaccagtgtaaattcagtcttttctctgaaaagcaaaggatgtgttttcagtctttctatcaaatattatctttgttctcctaatgctctgaaaggatgtagaaacaatatttaaccaaagaacgtaataaaccaggtttgcacct

SEQ ID NO: 1534 - DNA, 2292 bp, Homo sapiens
acaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcctggaggcgtgaagaagtcggccacactcagatcttttgaaggtctgatggggacaatcaagtccaaagtctcagggggcaaaagagcttggccctgactgtctttcttctgcggagggtggggttgatctgctctcagttttggggtgtggggaagacccactccagattccggggagtgggaatgagccactcccagttctggagagtgaggatgaccatctccactttctggaaccagaatgagcccccttggtaaccttgcctggtactaaaccagtgcaaggacccccttcccttattacatttgcaactctgcccaacaaaaacaagcaagcaaaccacaatggtaaagtggttaattcaggaaattgacagaatccagttttgagaaaagaacacagatatttgctgcttttaagatagagaacccaaagttttgtacctggttatttttcacttaagtttgtagacgaaatgtgccattatattagctttcctgagactgtatctaatgggcaagtcagtggctccagaggggtcttaggccaaagcccaaactctcttttggaaaactagcttattagaaagccaaagtagagttctgtttaagcttgaaagaggtatgaagtaatctgtagtgtttttttggtttgtttgtttgttttcccttccccatttccttccttccctcagtctcaaagtcaccttgaaagcttcacctggcctacaacttttattttaaaaagatgatcaagaaaacttcatcttctctgagactcagaaaaagaggggaaaatagtggtagtgcactaattgttacattactaatatagcttttgtaaaactcgtttgttttcaaaggtctggactaagcaaaacaacagtgtcagtttaggaaattattactactttgaacacaaactgaaattgcaactttgccttgtgctttgtttataatttctttgtgtatcaaaatgagtgtttttaagtttaacccttgaagcagcatgtctttgccatagcagcacttcacttaaaaggaagaaattgcctctctggcagcaattcctagttagttaccacctccagctgaggggctggaggaaaacaggtatagccaaattcaagaaagataaacccctgtctcaaggaacattttaaaaagaacgtctgtcccctgtgatgctggctgttatgcctttgaatggacctaactatacatctttgctcttaactccaagtctgcccttctttttaggaaaccctaaaggagaaggaagcagaatataaccctctggagagctcaagacagtaggaacctggacggtgcttgtttgaattttctgatatctgattttcacacgaatatactttttgtttgttttccttttccattttcaaaatgccaagatctgggagcctctttcactcctctagacacactgcctgagatagaagtttgcatcttattggctgtgggcagagactaggacccttatgggtacatttcagtaatctctcactgcctaaaatggtaatccctccagcctaagaggatgattctgttttgttgactcttgaatgctcccccaacattcctttggttttcctataagcaaaaccaaataccactataaatacaaaagcatctggtaaactgtaaagttactcatgtatcccaaccctccacagatttctgaagacaaagttttgcttggattaaaacaagatgttttactattt

SEQ ID NO: 1535 - DNA, 1894 bp, Homo sapiens
agcgattcgcgtcccggaagcggcggtggcggccgcggcgtaggcggaggagattttcggacctgcgacttccgaacaaccctggcaggaggagcggcgttcagccgggggaggcctgaagaaacgctccggggcccagtggctctacccctgctcctgcccgaccctgccgcctccctcacggagccagcggccgggtagaatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtggcagatgcctttgtgttccttgctgacctgcctgggcctcaacgtcttgttcctcactttgaatgagggtgcatggtactcagtaggtgccctgatgatttcagtgcccgccctgctgggctaccttcaggaggtttgccgggcacggctgcctgattccgagctgatgcggaggaagtatcatagcgtgaggcaggaggacctgcagagagttcgcctgtctcgtcccgaggccgtggctgaggtgaagagcttcttgatccagctggaggccttcctgagccgcctgtgctgcacatgtgaagccgcctaccgcgtgctgcactgggagaaccccgtcgtgtcctcacagttctatggggctcttctgggcacagtctgcatgctgtatttgctgccactctgctgggttctcacccttttaaacagcacgctctttctggggaatgtggagttcttccgagttgtgtctgagtacagggcatctctgcagcagaggatgaacccaaagcaggaagagcatgcctttgagagtcctccaccaccagatgttggggggaaggatggtctgatggacagcacgcctgccctcacacccacggagagtctctcttcccaggacctcacaccgggcagcgtggaggaggctgaggaggctgagccagatgaagagtttaaagatgcgattgaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcggtgtgacaggagcaggcagttcttaagggttcagagcagccagattccagcagtgcccggtaacactacacacaagaagtattactctggtccagcaaataatttgtctatttctacaacttctaagtaaagggaactgcacgggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagctt

SEQ ID NO: 1536 - DNA, 1594 bp, Homo sapiens
gacgagaccctccctcagcacctgcagtgcagccagagccggtgcggcggccgcgacttccccgacgcggggcgctgagaagcactatgaccaccaaagattatccatcattgtggggctttggaacaacaaaaacattcaaaattcccattgaacatctagatttcaaatacattgaaaaatgttcagatgttaaacatctggaaaaaattctttgcgtgctcagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaagagttgggtatcagaaattaaaaaagaagaagataaaatgcactttcatgaaactgagacatttccagcaatgaaagataatttgcctccagttcgtggttcaaacagctgtcttcatgtaggcaaggaaaaatattctaaaagaccaactaaaaagaaaactccaagggattacgcggaatgggataaatttgacgtggagaaggaatgtttaaaaattgatgaagattacaaagaaaagacggtaatagacaagtcacacttgtctaaaattgagacaagagtagatacagcaggtctaactgagaaagaaaaggattttcttgccactcgtgaaaaggagaaaggaaatgaagctttcaactcaggagattatgaagaagcagtgatgtattataccaggagcatatcagcgcttcccactgtagttgcctataacaatcgagctcaagcagaaatcaaattacagaactggaatagtgcttttcaggattgtgaaaaggtcttggagttagaacctggaaacgtaaaggctcttctgcgtcgtgctactacatataaacatcaaaacaagctccgggaagctacagaagatttgagtaaagtactagatgttgagcctgataatgatttggccaagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagagtaaaatattttttctatttaggttatgtaaaaagctgccttttaatatgatgagctggctcaatttttctattcgtacagaaattcgtaatctatcagtttttctagctttgccttgtaaattcacaagccagtttcgctcatctttttcttaatacagcttggtagaatctctcaaacccattttccttcttaacctgtcacctttttctagtgctcagtttaattcctggtcatcacctttaaatgtaaatggctgtgtttatttgacacagaccatttgccagttaactttaaatatctctctttgataattgttttgtatatatctacttgattgcaaacaaatgtgttggtttcaaaacaggtatgggtagccccatttatatgccaaaaatgaacgtattactag

SEQ ID NO: 1537 - DNA, 1793 bp, Homo sapiens
aaaagactgcggttcctgttactcagcagcctcaaaaactcacaccagctcctgcaaggaatgtgaatcttggagctcccagctattctgttcctgtttctgtcagctccttccctgaaaactcagaggtgctcagcatgccatgctaaaaggcaaaataaaaagatcttggagacatctcagctttaatgaggactttccaacattccagactgccgtcctgcaatgaagctctgagtcacggtctgtgaggctaaggtactggcaacggtgtgaaccccaggacaactaacctcactaaccttcactctaagcagaagcccaaagtgagtctggcctgaaatcagagcaagcactacagaaagacatctttgttaatggaaagaggaaagaagaaaagaatttccaataagttacaacaaacttttcaccattctaaagaacccactttccttatcaaccaagctgggcttctctctagtgactcctattctagcctttccccagaaacagagagtgttaatcctggtgaaaatataaagacagacactcagaaaaagagacctgggactgtgatactatcaaaactgtcaagtagaagaattatatcggaaagccagcttagcccccctgtgatcccggcccgcaggcctggattccgggtatgctatatctgtggccgagaatttgggtcccagtcaattgccattcatgaaccccagtgcttgcagaagtggcatattgaaaacagcaagttgcccaagcatttgaggaggccagaaccctccaaaccacagtctctcagcagcagtgggtcctacagtcttcaggcaactaacgaggctgcatttcagagtgcccaggctcagctgctgccctgtgaatcctgtggccacacattcttgccagatcatcttcttgttcatcacagaagctgcaagccaaagggtgagggtcccagagcaccacactcaaacagttctgatcatcttactggcctcaagaaagcttgtagtggaaccccagcccgaccaaggactgttatctgctacatatgtggtaaggaatttggcaccctgtcccttcctattcatgagcccaaatgcctggaaaagtggaaaatggaaaatgaccggctccctgtggagctccaccagccactcccacagaagcctcagccccttccgaatgcacagtccagccaagcgggaccaaatcaagctcagcttgtgttctgcccacattgtagccgaatctttacctcagaccgcctcctggtacaccagagaagttgtaaaactcatccttatgggccaaaatatcagaattgaatttagggagtaaaggaggcctaaaagagtacactaattccaagcagcaaaggaacagggcagcacccagtgtaactgataaggtaattcatgccacacaagacgcattaggtgaacctggtggtgccctctgcctgtaggggaacaagagaaaactatccccagaatcagccacctcagcccctagtattttttctatcaatgccttgtatcagcctcaaagcagcctgttcaagttaactccctgttgaactccagggcctatacctctcttggctgaatagatataagaacatccttgcctaatgggttcatattcctcttcaattctgctgtctaaaagaagaagagatggacttctttcttccctgatccctgatacaaataatccctgggagagacagtaatttgaaaatgagtcattaatgctgtgtctacattacagagatataattcccattc

SEQ ID NO: 1538 - DNA, 1921 bp, Homo sapiens
tgtgtgtagctgtagctcactcatttatattgctatgtataatattgtgctgcatgaatatgctacagttttctatttcactgttggtgggcatttgggtttctggattttttgctgttatgcataatgttctatgaacattcttatctatgtctcttatgcatttgcatgtatttctgtttgatatatactcagaagtaaaattgctgggtcatagagcatgtgtatattcaaatacagtagatattgccaaagaatttttcaaaggattgtgtcaatttaagtactcacaggcaatgtaggagagttatggttgctctgcattcttacgaacgcctagtattgtcgatcttttttattataacaattctgatgagtaaatttagtgttatctcatttctttacaattccctagtgagtaatgaggttgagtaccttttcatatgctatttagatatcttttttgtaaagtctgttcaggcatcttgctgttttcttctcttatttgtctttttcttactgattctaggaattaaaaagaaaaactattctgggaatcagttttctgtccattatgtgcattgcaaatattttctcatatccatggtttgctttttcccacttgatgatggcttttgataaacagaagtttttcattttcatataatccttttatcaataattagtctttccccttataattagtgctttttgtgactatttaatgaaagcaacttcagaatgctttaattttattcataattgagaggatttggagaaggctaatcttttctgatttacttgtctctaaaggcatcacacttttgggtcccaaccttaagcttcaggtctgagtgggggtggttactagaatctcttttccttggacgcctaagattccatttttttgtttcccacctatacaagtctgtgaaatctctgcccagtttcttagactctcaaatgcttttctgtaatttgcagacatctcagggagaaagcacaccccaaaccaggtttcatctgagactcccatactatcctagatggggtgtgagggggtctctgtaattcctcactgtcttgatatctctctgatgcttacgaggagatttttaacaaaacatttcatccagctatcctaattgtcatctgatgagctgttttgagtcacccagtctgctgcctactgaaagtggaactctgggaatctgataaaagagtgggtaatttcatgtgtcattacactggggattattcagtctttgatgaagcaacaacttgctagcttgtaagagccctaccaagtgagggtctttcctctgttacagggtaccaatatgtgaataactatcattgtcttgttagcagtggggccctgactcacgtgaaggaattatagcattttgaggtggcacatgtttagttgatcacataaatatttaaaaaattgaaattcagatgaagtaataactattttttgatacttattttttgaaaaacaggatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaatgtggaaagagtttttgaagtataattttaatgtttttattaaaatggtatatttgctaaaattccacaaccatcctagataaaaatgctcactgt

SEQ ID NO: 1539 - DNA, 1679 bp, Homo sapiens
agttcacactcccttaagttaaagagatacattctttttacaacagagccttatgttttcatctggctaattcagaagatatcttgttctcttttgaccagagacaaaagaagaaaagtcttggaaacatccttcacagtttggggatgaatgaaggcagagaaggaaccagtgtgaagagacacgacagtttgtgtggagaaaggggttgaccatttacaaggagagagccatttcctaagacgttgcttcatcaaagcatcctggaaccccagaagagggaagagtatcaaaccgcatctgtgtgcaagaagcctggctcccctccacatgcaactggaagaccaatgagaatcagaaaagcagtgaccacgggccatcctggagccacatgggggcagcgtcttctgggacacaggggaagcactgagaggcatttaggaaccagggatccatggtcattcttacttaaagaacacacccattatttacatcctatcccaatggtggcaaaataataccactgagctgaaaaggatctctacattctaccaaatcctggtattctcacatgggcttcttcaaaagtatagaaggttgtcaatgtgaacacagtgcacttcatgactatcatatcaatccctgagtgtttactttcttctcagtgacattaacactggaacatccatgtcaaggaagtacgatctgttcttttcaaactaaaacatgtccagtccggagtgggtgggagcaagcccaccttgtggccactactgaactaccaaaactccaacagagaaaccaattctgtgaagcctatggggaatgccacattttttctaaagaaccataaattaagtttaaattcatgtggtctgttcactaaatgtctttgcagaaggaaaagggaattggctccaaggattgcagttgctctgaaagtgcatgtggcatcaatactcacttctctaagtggggtcccaggacctgtggcatcagtattatctggaaacagaaatgcagactctcaggttccacctcagaacccctggaccagcttctgcatctccacagaatccccaggtcctctgtgcctttaggttggagaatcagtggaataaacaccaggagtgcaaacaagatcaaagaagttacctgttgtagttcactttttcaaataattgactgaaattaatttttataattaatgaagctagtgatgatttggaatcccttgactaagagaagggttttaatgtaattaatctgcaaaatgatcagtttttgtgcatcactaaacctatgaagtttataaagattattttcctagctggttatgaagaaaataatgtcacaaaagcatctaagggctgtgccttaccaatgagccgaccctctccagtctgctttcctgtaatcatagtgactcaatttctagacttagaaagaaaaaacacagaaaactaacatagaggattgttctcccttctggtcacggtttatggtagcaacaggtgaaaaaggccaacagaagcaacgatttgcctcatcacattaaaagaaacatttgctttctcttccaaaagcgtaagtagtaactatggaaaccagacaaaaacgttgaaaatgacttgcaattcacaaagagcagaacaactctatttcacccaccaaaaaac

SEQ ID NO: 1540 - DNA, 1699 bp, Homo sapiens
acaaattgggcaattgcaagtggcagcagcagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccttgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggattt

SEQ ID NO: 1541 - DNA, 1907 bp, Homo sapiens
agatggaggcgcaggtcctgcagcggcagatcttgcacctggagcagctgcaccacttcctcaagctcaagaacaacgaccggcagccggatcccgatgtcctggagaagcgtgaaaagcaggccggggaggtggccgagggcgtctggaagacctcccaggagaggctggtgctttgctacgaggacgccctgaataaactgtcccagctgatgggggagagtgaccctgacctgttggtgcagaagtatctggagatcgaggagcgcaactttgctgagttcaacttcatcaacgagcagaacttggagctggagcatgtgcaggaagagatcaaggagatgcaggaggctttggtgagcgcacgtgccagcaaggatgaccagcatttgctgcaggagcagcagcagaaggtgttgcagcagcgcatggacaaggtgcactcggaggctgagcgccttgaggcccgcttccaggatgtgcggggacagctggagaagctcaaggctgatatccagctcctcttcaccaaggcccattgcgacagcagcatgatcgatgacctccttggggtcaagaccagcatgggagaccgggacatgggcctcttcctgagcctcattgagaagcggctggtggagctcctgacagtgcaggccttcctacatgcccagagcttcacctccctggccgacgctgccctcctagtgctgggccagagcctggaggaccttccgaagaagatggccccacttcagccccctgacactctagaagaccccccgggttttgaggccagcgatgactaccccatgagcagggaggagctgctgagccaagtggagaagctggtggagctccaggagcaggcggaggcgcagcgccagaaggacctggccgccgccgccgcgaagctggacggcaccctgagcgtggacctggccagcacccagagggccggctccagtaccgtcctggtgcccaccaggcacccccatgccatccccgggtccattttgagccacaagactagcagagaccgtggctctcttggccacgtcacttttggcggcctcagctccagcactgggcatttgcccagccacatcacgcacggtgaccccaacactggccacgtgaccttcggctccaccagtgcctcgagtgggggccacgtgaccttcagacccgtcagcgccagcagctacctgggctccactggatacgtggggtccagcaggggcggagaaaacacagagggtggtgtggagagcggaggcacagcgtctgattcgagcggaggcctcgggtccagcagagaccacgtctccagcaccggccctgcctccagcactggcccgggctcctccaccagcaaagactcccggggctaacacgaggggcacgcagcccccaccctgccctggctctctgtggggtctttttttgtgtctctacttcccctgtttgccttgtgggtctctgtctttttctcccagtggcaggcctctgtctttttgccccttcaactgttttcatctgcccttcatcaccgcctcacctgtgtctcccggttcctttctctctgctcctgacactgcttttccctctgactcctgatctcctgttctctgggcttcctggtcagtgtctgtccgtcttgtctccatatctgccccttccctgtctgctgagccctggccccctgtggatcccccacctcctgtttccggctctctctcctcatctccatctcccaggctctccacgcatcctgtgtccctgtctctgtagctccttactccccaagagccccccagtgctgacaggtgtgggaaaagtcagggcgaagacgccaggttcagcatgggaaaatgggactgtggaaataaagtatatgtgtggag

SEQ ID NO: 1542 - DNA, 1778 bp, Homo sapiens
accgggctaggatacagaatggaaggtgtatgagagctgggatttttatctgttttgctgtatgaagtagatgagggaagaatcaagactgatgataagattatttcaactcaacataccagtaaaaccggctccaagatcaagacagagaatgtttccagccccgagaagctgccctggctctccttctggtcagtacccacccctgcccccaagggtaaccactctcccgtcaccaggagcccacccggtctggaccttcctgtcagtgagaccagcgtgtgattttttgcaggcgtgggctttctgcactcggcatgagctccgcccctgctgctgcctgtagccagggtgaccagtgggcttttaccttaagcagcaggtagacagtggggctggtgacagctgcggggatccagagttctgggaggtgtggcggaccagctgggcccaggactggggttggaggtgaaagtcaggcaacgtcagctcatcgacagcatttcaagccgtggaatttgagtactattgagctggccgtgccactgatggaatcgtttcttgctgctgcaaaattgagagccacatgctacaggtcaggccttctgcccccctatccgctgtgaggtgcttgaaggactggtttggaaacagacccctatttcagaagcagagttgaggcttagcaagggagaatgactggcccaaagtcactcggctggtaggtttgggccaggactcctcgctccgcactggacacccctgcactgccttctgggtgtgccaggttggcatggggaggctgggctcacacccaaatcaggacatagcctatcgtgagggtctgggtgagctgggaggtgttcagaatagaagagcaacccatgaaggctccccggaggaagcaggcctggcgctgagtcacaggagcctggggcagggtaacccccacctgaagtcactgtctccccagcagtgacatcattagcaagccagaatgcgcagggcatacagctggaggaccaggcaagctgaggcgggggccaagtgggtagttcggggccaacccccatcagcggccaatggcctctagaagatggctgggcctcacacgccttggaaaccagagcgagaggccatcagggtggggaaggcagcccatcacctcctgtccaagtgcctcattttacaggtagaggaactgaggcctgaggcaggtcatgactatcccaggattacacggcaagtgaggggcggatgcaggagaggggcccaggcctcctccctcccaacagtgttctgtctaccctccaagttctgtctcgcccagccaagggccactctgctcccgcactgctgggctggggtggtggaagagatgggaaagtggaagaaggcaagggctgtgtccagaaggggcccctgaggctatgaggatggtccatgccctcagggagtcaggctggtggagggggagggagcacaactcagaactcatcttcctccccaacacgctcctcccacagtcctatctcctcaccaggcccaggagctggcgcctcagcaactgctgcattttcaggaattttgcaaactggcttcaaaacacagccataattagacgtcaaagtatttaaacttacagttcagggccaggcttggtggctcacgcctgtaatcccagcactttgggaggccgaggcaggtggatcacttgaggtcaggagttcaagaccagcctggccaacatggtggaacccagtctctactaaaaatac

SEQ ID NO: 1543 - DNA, 1824 bp, Homo sapiens
gtggtgtttcaccaacttcggcctatggctctgtctgacgtcaccgaagtgacggaacggaaaagcgcgagaagcggctcggttcccaccacggagaggcgggagtgagtcaactgacaagcgctggggacagtggcgtccttgtcttgcctttgtctctcccgccccgctcttccctggctgggctggcggaggccttgctgatgaacctgactgagggtcccctggcgatggcagaaatggaccctacacagggccgtgtggtctttgaggacgtggccatatatttctcccaggaggagtgggggcaccttgatgaggctcagagattgctgtaccgtgatgtgatgctggagaatttggcccttttgtcctcactaggttcttggcatggagctgaggatgaggaggcaccttcacagcaaggtttttctgtaggagtgtcagaggttacaacttcaaagccctgtctgtccagccagaaggtccaccctagtgagacatgtggcccacccttgaaagacattctgtgcctggttgagcacaatggaattcatcctgagcaacacatatatatttgtgaggcagagctttttcagcacccaaagcagcaaattggagaaaatctttccagaggggatgattggataccttcatttgggaagaaccacagagttcacatggcagaggagatcttcacatgcatggagggctggaaggacttaccagccacctcatgccttctccagcaccagggccctcaaagcgagtggaagccatacagggacacagaggacagagaagcctttcagactggacaaaatgattacaaatgtagtgaatgtgggaaaaccttcacctgcagctattcatttgttgagcaccagaaaatccacacaggagaaaggtcttatgaatgtaacaaatgtgggaaattctttaagtacagtgccaatttcatgaaacatcagacagttcacactagtgaaaggacttatgagtgcagagaatgtggaaaatcctttatgtacaactaccgactcatgagacataagcgagttcacactggagaaaggccttatgagtgcaacacatgtgggaaattctttcggtacagctccacatttgttagacatcagagagttcacaccggagaaaggccgtatgagtgcagggaatgtgggaaattctttatggacagctccacactcattaaacatcagagagttcacaccggagaaagaccttataagtgcaatgattgtgggaaattttttaggtatatctccacactcattagacatcagagaattcacactggagaaaggccttatgagtgcagtgtatgtggggaattgtttaggtacagctccagccttgttaaacattggagaaatcacactggagaaaggccttataaatgcagtgaatgtgggaaatcatttaggtaccactgcaggctcattagacaccagagagtccacacgggagaaaggccttatgagtgcagcgaatgcgggaaattctttcgttacaactccaacctcattaaacattggagaaatcacactggagaaaggccttacgagtgcagagagtgtgggaaagcctttagccacaagcatatacttgttgagcaccagaaaatccacagtggagaaagaccttatgagtgcagcgaatgccagaaggcctttattagaaagtctcacctggttcatcaccagaaaatccacagtgaagagaggcttgtgtgctccatgaatgtggggaattctttagctaaaactccaacctcattaaacatcagagatttcacaatgg

SEQ ID NO: 1544 - DNA, 1765 bp, Homo sapiens
aggacagcttccggaatatgggggcctttgtctcccgctgcagctggagctctacgtctagtcttcagaggcccagtctccgtgactttgtgacctgcaggtattgggagatccacagctaagatgccaggaccccctggaagcctagaaatgagaccattgatatttagggatgtggccatagaattctctctggaagagtggcaatgcctgaacacagcacagcagaatttatatagaaatgtgatgttagaaaactacagaaacctggtcttcctaggtattgctgtctctaagccagatttaatcacctgtctagagaaagaaaaatatccctggaatatgaagagacacaagatggtagatgaatccccagttatctgttctcattttgccaaagacctctgcccggaacaagacagaaaatgttatttccctgaagtgatactgaggagatatgataaatgtgaacatgagaacttacaattaagaaaagtctgtaaaagtgtagatgagtgcaaggtgcacaaacaaggttataatggacttaaccaacatttgacaactacccagagcaaacttcatcaatgtaatgaagatgggaaagtctttcataaattttcaaatttaaatacacacaagacaagacatactggaaagaaacctttcaaatgtaaagaatgtggcaaatcattttgtatactttcacacctaactcggcataaggtaattaatattgaaaagaaaccccacaagtctgaagaatgtaggaaagcctgtagtgtgtcctcaaaccttactaaatgtaggagaattcatcctggagagaagccgtacaaatgtgaacaatgtggcaaagcgtttaactcttcctcacacctgactcagcataagataattcatactaaaaagaaaccctacggatctcaagaatgtaggaaagcctttagtgtgtcctcaaccgttactcaacataagagagttcatactggagagaaaccctacaaatgtaaagaatgtggcaaatcctttaagagatcctcacacctcactgcacataagagaattcatactggagagaaaccctacaaatgtgaagaatgtggcaaatcctttaggaagtcctcacaccttgctgcacataagagaattcatactggagagaaaccctaccaatgtgaagaatgtggcaaagcttataaatgctcttctgcccttactagacataggagaattcatactggagagaaaccctacaaatgtgaagaatgtggcaaagcttatatctgctcttcaacccttaataaacataagagaattcatactggagagaaaccctacaaatgtgaagaatgtggcaaagcttataaatgctcttcaacccttagtaaacataagagacttcatactggagagaaaccctacaaatgtgaagaatgtggcaaagcttataaatgctcttcaagccttactagacataagagaattcatactggagagaaaccctacaaatgtgaagaatgtggcaaagctttttactgttcctcacaccttactagacataagagaattcatactggagagaaaccctacaaatttgaagaatgtggcaaagcttataactggtcttcaacctttgctaaacatgagaaatcatgctggaaagaaacccgacaaacatgaagaatgtggcaaagccttcaaccagtacttaactcttactaaatataagaattcatttggaaaataaaccctacaaatggtg

SEQ ID NO: 1545 - DNA, 2485 bp, Homo sapiens
agaatacggtgagaaattccaggagcacagaagtcagcgggcatctcctggagacaggcagacatttggtctcagcagccatgcccaaagtcatgaaggatgttgtgcaccccttggggggagaggagcctagcatggcgagagctgtggttcgcagcgtgggaggctttaccctgggcttgtctttagccacggcctacgggcttctggagctactggtggaaggccacagcccctggggttgcctggtgggcaccctcactttggctgccttccttagcctgggcatgggattctctcgccaggtccgagccactgtcctcctgctgctgcctcaggccttctccaggcagggccggacactactgttggtggctgcttttgggttggtgcttcaagggccttgtgccaacactctacgcaacttcacccgggccagcgaggctgtagcctgtggggcagagctggccctgaaccagaccgccgaagtgctacagagggccaagcaacctcttgtcagtgccctgaacaagattaaagctattgcccggaagaccaaagaggtggctgaccgggtccgcaagttctttcggtcaatcatggatggtgtgaaacacatagccagggctctccggaatgtgtggcagtggctcctgcacatcggcgatgtgtgcaactcggaactgggcaacccttacctgaagtgtgcacgggttttcgatgatgccaaggacagctgcatgatggtcataccacaagcctaccacctgtgttacgtgctcatgcccttcaaactggcgctctgtggacttgccagcctggtccaggtgttctgcgtcatccctaagtacattcaacccttcttgcgccagaccatcggcacccccgtgattcagttgctcaaccgggtgcgtcaggagtttgagttcaacatgacagccacccaccacttctctgtggatctcaatgcctctcggagcctgtcccaggtagccatggacctccacgaggctgtcagcatgaagctgcaccgtgtccgagaggccctggctctgatgggcttcaccacgcctctgctgcttgtgcttctctacctccaagccctattttaccggtattgttacctgaactgggaccattatgacaatatctacatcactagccgattcctgcgcatggaggctgtgcgctccacggcagggctgcccacagtgctaccgctcagtgctcacgaggccaggcgctacatcccaccgggctccatcttcttgtcccaatgggagaagtttttttacattctggagaccttcaaccttatccgacacctcctcctcgtgctgttcctagtcttcctagactatgctgtcttctgggtgcttgacctggcccggcaccagctgcagggggagattgtggcccgcagtcctgtgttggtgtctctaaccgtggaaggtactggctacgctgggaatatttatcgtgacctggtgtcagcatttgatgtcctgcagcaaggcaacatcagtattttgtcccggcgttgtctccttcgtccctcggagcctgacagcactggctacatagtcattggcgtcatgtatggcctatgcttcttcatcaccctgtttggcagctatgtcagccggctgcggcgagtcatctgtgcctcctactacccatcccgggagcaggagaggatctcctacctgtacaatgtacttctgagccgccgaaccaatctgttggctgccctgcaccgatcagtgaggcggcgggcggctgaccagggccacagaagtgccttcctagtgctggccagtcggtgcccctgcctaggtccatttgtcagccacttttggctgcatcaggcctactgcctgggctgtgggcagccccaggatgagggagacatggagaacactgtgtcctgcagtacccccggctgccaaggatttatatgcaagtggcattgcagcagctccctagtgtgcaccccttgacaaggatggttcatccaggtctctactgcctcacttgcttccgcctcctggacaatacctgctccgtgtgtgcatctcccctctcctaccagggggacctggacctggagctggactccagcgatgaggagggccctcagctatggctggctgcagctcaaaggaaggaccctgagcaggcatggttattgcagcaacagctccaagaagtgctcggcaggagcctctcaatggagtccacttccgagtccagtgacctggatgaggagaaggggcctcagcagaggaagcacgggcagcagcccttacctgaagcccatcagcctgtcagcattctcaccagccctgagccccacagaccacctgagacatcctccgccactaaaggagcccccactccagcttcagaaccctcagtccctctctcacctccctctcttcctgatccttcccacccaccccccaaataaaccaaaagtggacac

SEQ ID NO: 1546 - DNA, 2107 bp, Homo sapiens
attctgagcctagccacagaggtaaactccggacatttttttctttcatgtagccaaatacatccttgtcattaaaagacctttgaaactgagtaaaatggctttgaaacctcagtagaatatgctcaaactgtctggagaaggattacgggacagctaccacagtagaagagatcaaattgcccttaaaaatctccagtctgatgtcacagaggcgaaatctgacttcaccaaggagaccctggcatcacaaaacacaaaaatgatttcatccatagtcatctcccagatgattgatgagaataagtcaagagaaaacagggcctccttgcccctaccgtgtgccattgctcagtctcgtgcgcatcacgccaagcaatctctggctaaccgcagcggagtcaacattcacagagcatttgcgttacttccgggcagattaggaatcccggcaccgtcagatgagcgaggacctgaggcagagctgccgcccaaagaggagagaccctgtgggggcccccgcagagggtttgcatccatcaccatcacggccagacgcgtgggccccccagcccgcgccctggtgtgggggactgctggggactctctgtgccccaagtgcagggctgaggacacactgttccaggcgcccccggctctggccaatggcgcccatccaggtcggcatcagagatcttttgcctgcacagagttctccagaaacagctccgtggtgcggctgaaggttcccgaggcccacactgggttgtgtgagagacgcaagtactgggtcacccatgcagacgacaaagagaccagtttttctccagacaccccactgtcaggaaagagcccgctggtgttcagttcctgtgtccacctcagggtgtctcagcagtgtccagattcaatctattacgtagacaagtctctctccgtccccattgagccacctcaaattgccagccccaaaatgcacagatccgtcctgtcgctcaacctcaattgtagttcccacagattaacagcagatggagtagatggcctagtgaacagagagccaataagcgaagccctgaagcaggagctcctggagggagaccaggacctcgtaggccagcgctggaacccaggtttacaagaaagtcacttgaaggaaaccccatcgttgaggcgggtgcatttggggaccggcgcttgtccttggagtggttcttttccattggaaaacacagaattggcaaatgtgggagctaaccaagtcactgtaagaaaaggggaaaaggaccatacaactcattgtcacgccagcgatcatgccaaccaactgtccattcacattcctggctggagttacagggcagtacacacaaaagtattttctggaagcagcaagaggcaacaaggagaagtatgtatgactgtgtctgctcctccagtggaacagaagcccactagacatttccttcccattggggatagctctccaagcgatgactgtctgtctagagacctttctgagcccacagagagacgacatcaaagcttcctgaaacccagaatcctttttcctgggtttctttgccccttacaagatgtatgtgcatctctgcaggaagacaatggtgttcagatagaaagcaagttccccaaaggagattacacatgctgtgacttggttgtaaaaataaaggaatgtaagaagagtgaggaccccaccacacctgagccctccccagcagcaccctcgccagcaccccgcgatggagcagggagccctggcctgtccgaagactgttctgagtctcagcaaacgcctgcaagatctttgaccttgcaagaagcactggaagttcgtaagcctcagttcatttctcgctcacaagaacggctgaagaagcttgaacacatggtccagcagaggaaagcccagcggaaggaggacctgaggcagaagcagagcctccttcccatccgcaccagcaagaagcagttcacgattccccatcctctgagtgataacttgttcaaacccaaagaacggtgcatttcagagaaggagatgcatatgcgatctaagggaatctatgataacttgccggaagtt

SEQ ID NO: 1547 - DNA, 1743 bp, Homo sapiens
gtacatcagaaacaaaatgtgacctacagcaaacctaatgattataaattgctcttttccgatcctcccattttattgcttcccactccccaaaaaaaggactttaaccaagttgccaattcatcagcaatttatttttttccataaagtcaccaagctgccaaaacattcagtttggccatttaaaatcatttgaaataatggctttacatttttggaatttatttgtttatatatttatatttcattggtgcaaaagtgctttcaaagcagggattgctctcactggttgaggacatatcttgactccctaacgttttcactggaagttgacagagatgatatttaaaatgtataacaagtgagagcataggcacagaccagtcaggatggatgccaatcacaggtaaaccatggggctattccagtatacattagcagcatcttggtcctggcagtgaccatctgtaaaataagaacaataaagtcctaccttcagagaatttattgtgagcattagagaagataattcatgtgaaggatctggcataatatctgacacattgcaaaaagtccaagctacctttattttcttagttagcagatatgcttattttcttgagctctttggcaaaatttttgtaaactttatcgagcagaatgtccaatgttacttttcataattcccttttgagcgggagttggcattcggtggtcctggcagttagctgagcacgccctctgagccgctcggtggacaccaggcactctagtaggcctggcctacccagaaacagcaggagagagaagaaacaggccagctgtgagaagccaaggacaccgagtcagtcatggcacctaaggcggcaaagggggccaagccagagccagcaccagctccacctccacccggggccaaacccgaggaagacaagaaggacggtaaggagccatcggacaaacctcaaaaggcggtgcaggaccataaggagccatcggacaaacctcaaaaggcggtgcagcccaagcacgaagtgggcacgaggagggggtgtcgccgctaccggtgggaattaaaagacagcaataaagagttctggctcttggggcacgctgagatcaagattcggagtttgggctgcctaatagctgcaatgatactgttgtcctcactcaccgtgcaccccatcttgaggcttatcatcaccatggagatatccttcttcagcttcttcatcttactgtacagctttgccattcatagatacatacccttcatcctgtggcccatttctgacctcttcaacgacctgattgcttatgcgttccttgtgggagccgtggtctttgctgtgagaagtcggcgatccatgaatctccactacttacttgctgtgatccttattggtgcggctggagtttttgcttttatcgatgtgtgtcttcaaagaaaccacttcagaggcaagaaggccaaaaagcatatgctggttcctcctccaggaaaggaaaaaggaccccagcagggcaagggaccagaacccgccaagccaccagaacctggcaagccaccagggccagcaaagggaaagaaatgacttggaggaggctcctggtgtctgaaacggcagtgtattttacagcaatatgtttccactctcttccttgtcttctttctggaatggttttcttttccattttcattaccacctttgcttggaaaagaatggattaatggattct

SEQ ID NO: 1548 - DNA, 1970 bp, Homo sapiens
aggaagtgagcggatgctgggcggggcactcttccacgccttgtagaccatgtctggcatcaccctgttcgaaggaataaattcaaatacctgattgaccatcccgtctccctcacaggagctggaagggatatttcttttctgtacgatgtaacatatgccaaaggacagactagggagaaggcagtttgtcccccacatttggcccgttcattacagtcacatgatggtgtcattgtgccccataagccaaagacactaacagatactttgattcctgaagaatttcatattgtgtcaagtacaggagtttcaggtttggagtgttatgatgacaaatacactactctcctcacagatagtgaaaacaggctattgctcttcccatccatgaaacctaataaaagagtagaagtggcccagctgaatgatgtgatggatactatgctagagagggctggtgtggaaaatcaggaatatacaggaccaacgaagatgcacaaactactacatatattgaagaaggaacagaccatttacaacatgatatttcatgaacttattcgacaagtcagtgtggactgtgcagacagaggagaacttctgtctaaagtcagagagaggtatgtgcaaatgcttgaccagattgctcggcagatgattgatttctacaaagacttggtaactcagcgagtgatggaccagcgcattttagaagaattgtataatttcaagcatgttattgaagaactgaccagggaactgtgtctagttcgggcacatgatgtgaaattaacaaaggaaacagaaaaagcccacaaggatttggcacaagctcttttaaatgcggaaaagaatgccaaaatagtagaagaatatcatgacttatatacattacaaagagaaaggatggagaatgatatgaaaaagttagtggcagaaagagatatctggagctcagccacatatgaattggccctgaaggtgattgaaagaaatagagtcatattggctagaagactttaccttaatgaaaaaggctggaataaatacactaagcatttcatcatactgctatcaaacaaggacactgaagaccttgcactgttgcagaagttgacacaaaaatggagaaacttagtgaataaacttaaacaagaggtagaacaaatggaagagtctacaagcgagacactgaaaattgttaaggatgggcttatcaaatggcaggagttcttcaatgaaaaagacattttatcccctaataagggaaatatatttaattcagttcttttagacttcaaacagtggcagaagatcctgaatgagaaaaaagaagagtttactggggatgttctactgtcaaaatacgatactctcaagattattaaacatttacaggaaaactgggcagatattgggcttgggatatttaatcggcataaaagtttggagggggagatgccatcagagcgacagtacatggaggaaattatcaaaaacatacaaaaactctacaaagaatatgaaataagaataaatggggacaatgagacaggatctcaccgtgttgcacaggctggtctcaaacttctgggttcaagcgatcatcccacttcagccccccaaagtgctggaattagaggcataatccaccgcacctggccttgggttaatttttatatagtgtgtgaggttactccaaaattcttccaagtttgattagttctcttgacttctgttctttcaagttggaaaacctggagtttcctgatacgcctcttgaagaatggcaggaaatagatgaaaaaattaatgaaatgaaatcacacttggatatattgttaaaccttactggtattgttccacagcacatagatgtggattctgtttcgtaagttcccataggtttcttttgttctgagataattttcctaaaggtttattgcaatacacttcatatataattc

SEQ ID NO: 1549 - DNA, 1620 bp, Homo sapiens
aattttcagaagtttcgtatggggatggttttatataaattcaggtttttcccacaataataaatgtatttagtctcagtgctcaatagaagagatttctaatagaaaaggattcaaactgtgaaaccatttctcttttaatgtttcacattcctgttacagatttgttctcttgtgactctgttatccataatatggacagttcttgagtcctaacattgagaggttttcccttagtgcatagagggaatgagtattaattggagaagcttaaagtattgccactttagcactgaagattgggatgagaggaggtgaaacctcactagaaaaagggacaatgttagtgtggcccttcctgatcatgtttaagaaaagtcatgaaaatggtgaactagtgtttccaagcatattggaagggttgagtgtatactgtctgtcaaagacttccagcatttccaggtcctagagaggaacaagactggtaacctgcctatctgtatttttaagaacccaggaggaaagctttataatagaacattatttctgtgtttatgtataaggggttttttgtttttttaaagacaggatctcactccattgtccaggccaagtgcaatggcacgaacctcatagctcctggacttaagtgatctgcctgcctttgcctcctgagtagctgggactacaggcatgagcccccatgcctggctaagtttgtttttttgtttgtttgtttgtttgtttttggggggggttgttttgttttttgtagagacgtagtcttgctttgttgccaggctagtctcaaactcctggcttcaagtgatcctcctgcctcagcctcccagagtgctaggattacagcacttggattcagcttcttcatttccaacatggaagaaacttacaccgactccctggaccctgagaagctattgcaatgcccctatgacaaaaaccatcaaatcagggcttgcaggtttccttatcatcttatcaagtgcagaaagaatcatcctgatgttgcaagcaaattggctacttgtcccttcaatgctcgccaccaggttcctcgagctgaaattagtcatcatatctcaagctgtgatgacagaagttgtattgagcaagatgttgtcaaccaaaccaggagccttagacaagagactctggctgagagcacttggcagtgccctccttgcgatgaagactgggataaagatttgtgggagcagaccagcaccccatttgtctggggcacaactcactactctgacaacaacagccctgcgagcaacatagttacagaacataagaataacctggcttcaggcatgcgagttcccaaatctctgccgtatgttctgccatggaaaaacaatggaaatgcacagtaactgaatacctatctcatcaaatgccagaccctagaagactgttgcttcttcttctaccagtgggttctcattttcctcctaatctaattatagaatggtaaactccctgtgactttccaaactgacaagcacacttttttcctccccccttgaatcctcatttaatgcaagaaccctcatactcagaagcttccaaataaacctttgatacagattgctt

SEQ ID NO: 1550 - DNA, 1907 bp, Homo sapiens
acccggccgctccagtccagtcgtgcaggcggcgcgctctttctcgctccgctcaagtccaggaaccggttcccgggctcccagcctctcggcagcgcccacgcgcctgggccaaagtccgcgaacggaagccggcggcgaggaggattctgggagttggaggccgaggctgcgacctgcgcaggcgcaaacctgcccctggggtgagggctgtaagtggcgcgattcgcggcagcgccccgatggaacctcctggtcctgtgagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggggttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtgggaagggggatttggtctgttatgggagccagattgatgaccttcaggctggaccgaggggcagctgtagggggaggtgccaagttcaaacctctcttgggccaggtagagcagttagtatgtgtttctgtgtctgtcttttctgccctcgagccctgaatgagaaagagactctagctcctcttcttcccttgtgctgactctgaggaggctctctaaagtctccttggaagctttggtccaaggagggtcacatctgcaagtgtccaggcaggggacagaaaccacactagtaatttgaagaaaatttaaactgagtggtgcctgatcacctccaggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctactttaggactggatcccataaaagttataagttccttaag

SEQ ID NO: 1551 - DNA, 1980 bp, Homo sapiens
agataaggaattgtataggaggaaacttcatagtaaacattgaacctctgtgcttgtctccttgttgaagttgggggttcatgtttattgttccaagggagcctcatcaaaaccacttttaaagcattgagaatccaaataaataccatggatcatacaggattggggataagtcttgaggtctccccgagaaggagaagttctttaatttggtaattttagggtaatggttggatgctctctggattaatggaaaccttcaggggtacttttaggcagagtataacccagtgaagagagcattattatatggtggaatgcgagagtctcagcctgaagcagaaattcctctccaagacaccactgcagaagcattcacaatgctactcaaatatatctacactgggcgggcaacgctgacagatgagaaggaggaggtgctgctggactttttgagcctggctcataaatatggatttccagagctagaggattctacctctgagtatctctgcaccatacttaacattcagaatgtctgcatgacttttgatgttgccagtctctactcacttcccaagttaacttgtatgtgctgcatgtttatggataggaatgctcaggaagtcctctcaagtgaaggtttcctctccctttctaagacagcacttttaaacatcgtgttaagagactcatttgcagctcccgaaaaagatattttcctagccttattaaactggtgtaagcacaattcaaaggagaatcatgctgaaatcatgcaggctgtgcgtttacctctcatgagcctcacagagcttctgaatgttgtgaggccttcaggactgctgtctcctgatgccatcctggatgccattaaagtgcgatctgagagccgggatatggacctcaattatagaggcatgctcataccagaagaaaacattgcaactatgaagtatggagcccaagttgtaaagggggagctgaaatcagccttattagatggtgatactcaaaattatgatttggatcatggattttcaaggcacccaattgatgatgactgccgttccggcatcgagattaagctaggtcagccatccgttatcaatcacatacggatactcttgtgggaccgagatagccggtcttactcatacttcattgaagtgtcaatggatgaacttgattgggtcagagtgatagatcattcacaatatctgtgtcgttcttggcagaaattatattttccagcccgtgtctgcaggtatattcgaattgttgggactcacaacacagtgaacaagatttttcacattgtggcttttgaatgtatgtttacaaacaaaaccttcactcttgagaaggggctgatagttcccatggagaatgttgcaacaattgctgattgtgccagtgtgattgaaggagtcagtcggagccgaaatgccttgctgaatggggacactaagaattatgactgggattctggctacacatgtcaccagctaggaagtggtgcgattgtggttcagttggcacaaccgtacatgattgggtcaatacggttactactttgggattgtgatgatcgaagctatagctactacgttgaggtttctaccaaccagcaacagtggaccatggttgctgacagaactaaagtctcctgcaagtcctggcagtcagtaacttttgaaaggcagcctgcctccttcatccgtatcgttgggacacacaacacagcaaatgaggtgttccactgtgtccactttgagtgtccagagcagcagagcagccagaaggaggaaaatagtgaggaatcggggacaggggacaccagcctggccggtcagcagctcgactcccatgcgctgcgggcgcctagtggcagctcactaccctccagcccaggctccaactcacgctcccccaaccggcagcaccaataaaggaggcagcgggcctggtgtgacttgg

SEQ ID NO: 1552 - DNA, 1576 bp, Homo sapiens
tagactcatcagagaaatagacaaattaaaggaagacattaactctcacgtcatcaaagtaaagtgggcacaaaacaaattaaaagctgaaatggattcacacaaggaaaccaaagataaactcaaagaaacaacaacaaaattaacacaagcaaaggaagaagcagatcagatacgaaaaaactgtcaggatatgataaaaacatatcaggagtcagaagaaattaaatcaaacgagcttgatgcaaagcttagagtcacaaaaggagaacttgaaaaacaaatgcaagaaaaatctgaccagctagagatgcatcatgccaaaataaaggaactagaagatctgaagagaacatttaaggagggtatggatgagttaagaacactgagaacaaaggtgaaatgtctagaagatgaacgattaagaacagaagatgaattatcaaaatataaggaaattattaatcgccaaaaagctgaaattcagaatttattggacaaggtgaaaactgcagatcagctacaggagcagcttcaaagaggtaagcaagaaattgaaaatttgaaagaagaagtggaaagtcttaattctttgattaatgacctacaaaaagacatcgaaggcagtaggaaaagagaatctgagctgctgctgtttacagaaaggctcactagtaagaatgcacagcttcagtctgaatccaattctttgcagtcacaatttgataaagtttcctgtagtgaaagtcagttacaaagccagtgtgaacaaatgaaacagacaaatattaatttggaaagtaggttgttgaaagaggaagaactgcgaaaagaggaagtccaaactctgcaagctgaactcgcttgtagacaaacagaagttaaagcattgagtacccaggtagaagaattaaaagatgagttagtaactcagagacgtaaacatgcctctagtatcaaggatctcaccaaacaacttcagcaagcacgaagaaaattagatcaggttgagagtggaagctatgacaaagaagtcagcagcatgggaagtcgttctagttcatcagggtccctgaatgctcgaagcagtgcagaagatcgatctccagaaaatactgggtcctcagtagctgtggataactttccacaagtagataaggccatgttgattgagagaatagttaggctgcgaaaagcacatgcccggaaaaatgaaaagatagaatttatggaggaccacatcaaacaactggtggaagaaattaggaaaaaaacaaagaaaatctacaaacacttggaacagaaatagaacgtcttattaaacaccagcatgaactagaacagaggacaaagaaaacctaaaacaagcctcttgctcagtaaagagacaaaagccacacaggagtaggtgccactgacctctattgttggagactttgttccactttttgtttcagccagtaaaaatattgttttgcttcatctgtacacaaaaaaatacccttttacaatatgaatgcattgctgtatatactgtaagactgaaagctttgatgaaatttgtttttgtatggtg

SEQ ID NO: 1553 - DNA, 3309 bp, Homo sapiens
tgttagggagtatggaaatgttggggccagtgccatggttgtatgttgagggagtgaaactctcttctcaggttcaggagaaggtattacaagaagaggaacccatacccagacagccctgctgttgtcctgcattgttgagggaggaattatgtcctatgtgtttgtagtaacagaatccacagctaagaaaagacaagctcaggagggaagtccttgggtagatgctaaagagccttctctttgttctttgtgccagaagctataggtttctaattatgatggcaggagaagtgtccttatgaagtgtgtcgctgtgtataaaaatatctctatgttttgttattgctgtgttctttgtgtgatagattttattaggagcacactctgtcctttccaaggacgtaatctgactgttttctgtttcctcttcttttttgctttgctttccaacctgatgatgtgctgctgtgttctgttgcaatgaaattccttcatctgtttcacatcgcaacaaaaagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagtgggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagctgcctgccgacactacggccactgtcgaggacatgctgccttctgtcaccaccgtcaccactaactctgacactatcaccgaaacctttgccactgctcagaacagccccaccagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagagtcttttgcctttaaaaaaaactaaacagataaaacatg

SEQ ID NO: 1554 - DNA, 2654 bp, Homo sapiens
acatttcacagtcgccatgacgaccgggaggtccgcaacggctgcggggacaagtccgttgaggctgccaggcgagtcaggtctctctggacctcgcctgactcggctgggctgtgcctgaaattgacccagctccaccatactccttgattatgagaaaacaaggagtaagctcaaagcggctgcaatcttccggccgcagccagtctaaggggcggcgcggggcctccctcgcccgggagccggaggtagaggaggagatggaaaagtcggccctaggcggcgggaaactgccaaggggctcctggaggtcctccccggggaggatccaaagtctgaaagagcgaaaaggcttggagctagaggtggtggccaagacctttcttctcggccccttccagttcgtccgtaattccctggcgcagctccgggaaaaggtgcaggaactgcaggcgcggcggttctccagcagaaccactctcggcatcgctgtctttgtggcaattttacattggttacatttagtaacactttttgaaaatgatcgtcatttctctcacctctcatctttggaacgggagatgacttttcgcactgaaatgggactttattattcatacttcaagaccattattgaagcaccttcgtttttggaaggactgtggatgattatgaatgacaggcttactgaatatcctcttataattaatgcaataaaacgcttccatctttatccagaggtaatcatagcctcctggtattgcacattcatgggaataatgaatttatttggactagaaactaagacctgctggaatgtcaccagaatagaacctcttaatgaagttcaaagctgtgaaggattgggagatcctgcttgcttttatgttggtgtaatctttattttaaatggactaatgatgggattgttcttcatgtatggagcatacctgagtgggactcaactgggaggtcttattacagtactgtgcttctttttcaaccatggagaggccacccgtgtgatgtggacaccacctctccgtgaaagtttttcctatcctttccttgtacttcagatgtgtattttaactttgattctcaggacctcaagcaatgatagaaggcccttcattgcactctgtctttccaatgttgcttttatgcttccctggcaatttgctcagtttatactttttacacagatagcatcattatttcccatgtatgttgtgggatacattgaaccaagcaaatttcagaagatcatttatatgaacatgatttcagttacccttagtttcattttgatgtttggaaattcaatgtacttatcttcttattattcttcatctttgttaatgacgtgggcaataattctaaagagaaatgaaattcaaaaactgggagtatctaaactcaacttttggctaattcaaggtagtgcctggtggtgtggaacaatcattttgaaatttctgacatctaaaatcttaggcgtttcagaccacattcgcctgagtgatcttatagcagccagaatcttaaggtatacagattttgatactttaatatatacctgtgctcccgaatttgacttcatggaaaaagcgactccgctgagatacacaaagacattattgcttccagttgttatggtgattacatgttttatctttaaaaagactgttcgtgatatttcatatgttttagctacaaacatttatctaagaaaacagctccttgaacacagtgagctggcttttcacacattgcagttgttagtgtttactgcccttgccattttaattatgaggctaaagatgtttttgacaccgcacatgtgtgttatggcttccttgatatgctctcgacagctctttggctggctttttcgcagagttcgttttgagaaggttatctttggcattttaacagtgatgtcaatacaaggttatgcaaacctccgtaatcaatggagcataataggagaatttaataatttgcctcaggaagaacttttacagtggatcaaatacagtaccacatcagatgctgtctttgcaggtgccatgcctacaatggcaagcatcaagctgtctacacttcatcccattgtgaatcatccacattacgaagatgcagacttgagggctcggacaaaaatagtttattctacatatagtcgaaaatctgccaaagaagtaagagataaattgttggagttacatgtgaattattatgttttagaagaggcatggtgtgttgtgagaactaagcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactgagaaggatactacccattttactatggcacaatgccgtgtgtcaaaaacaatcaccctttggcttattcacattaataaaaatcacaagctttaataacagacacttaaaaataagataaaaatggattggaaatttttctgattactaaaaggtaaattacttttctgttcattgaatgtcagccttattaagcttgtcatataagttattaaatcattcatgtc

SEQ ID NO: 1555 - DNA, 2304 bp, Homo sapiens
aagaataaaagcaggcggcctgaggttgcggtggtaacgtgttccggcgtccttccacactgtcgcggcctatgttgttttgctgtttgggtttgcacactgtctttttgagctgtaacacagcaaaggtttgcagcttcgctcctgaaatcatcgagaccacaaacctaccgggaagaacgaacaactccagacgcaccgctttaagagctgtaatactcgttgggaaggtgtgcagcttgactcctgagtcagcgagaccacgaacccatcagaaatcagaaggaaaaaactccgaacatcagaaggaacaggtttcagacacgccacctttaagaactgtgatactcaccgcgagggcccgcggcttcattcttgaagtccgtgagaccaagaacctaccaattctgaatacgttgggttcaagtggttctcctgcctcagactcccgaatagctgggactacaggcacccaccacgcccgggtaattgtatgacaatggagaggtgattactgcgctgaaaatcagtttcctgaagtgaaaaagggaatcaagttacgtcacagagcctggtgtgagcggcgctcagtcaacaccagctcttcatgggttgtggtttcctccagttcctggatgtgtggagttcatcctccactgactggcgccccggttgacaatgaggtctggcatccctggagttgagtaactagttctggctgctggtctccaggtgacatgtgtcacgtttgagctaagaattgcttcacatgattatggaggctgacaagtcccaagactcacagtcggcaagctggacacccaagacagctggtgctgcacatattaccagtgatgtagtttcagtctgaatctgaaggcctgagaaccaggacagttgatggtgtaaattccagtccgaggtcaggagaagcctaatgttctagcctaacatcttgcagcttttttgttctatgcaagttttaaagtaattggatgggacccagccacattagggaggccaatctgctttactcagtctaccaattcaaatctaatcttatccagaaacaccctcgtagacacatccacagtaatatttgaccaaatatctcggcactcaaaggcttaggcaagtcgatatgtaaaattaatgatcacaaggagggagaatgggttcaacaggtatttaaaagtattcataatagaaaagtatttattgtgtttatgtggcaggcagtattctgagtgctgttattgtatctcagttaaaacactagttaggtaagaaaagcgtcacctctgtgaggtggttactattattgtcctcatttagcagatgagaaaacaggcagagaaaaatttacatgatttgctggcactcatgcaactgataagtatctgaactgggattcgaacccaaactaactcagagtttaagctcttaactgccattctagagtcctccttggggacaggtgattgtaggtagaaaaaagaaatatggggagaggcatgctgaattgaaaaaaaaaacctctctaaatgaaactgagaaccacatcttctagtactaattataggtagagaactctgctaaatattttgcaagcattatccaatttaatgataaaaaccatactggacatgagaagccattatatccattttacagaaaagaaaaatgagctgggttggaattgcagctgggacatttttgatactgtgatcttagatacattcatctgtcagactccagctgattccaaactccttgttcattctattaggttgtgctataagaaaaaattctgtaagctttaaaagtggtaagtcaactcaaggcacagccaataagcatttatatgactgtacattatttacctaactctgcagagggagccagatatcctttagtgtagtaacgaagaatggctcctgcatatccccagcaattctcaggaaaaggtgggtgttatattctcttaaatagagaggcgtttttttcttagtcctattactggcagcttctaaatttaataacaaaatgctcacctacaaataagaagaataaaagcttaacttgccagggggaaaaaagttctatgatgtaacagacccaggaataagtgatattcatgggaaggtcactgcctgaggctgcttgataaactccagccctttcctatatccactgtttaatgtttaagctttggatgctaagagtggttataataaactgtccaacagtttctcacttagacttcccaagaaggtgacaaaataaaatcaatgtaaagctgtc

SEQ ID NO: 1556 - DNA, 1986 bp, Homo sapiens
acacatgcagcttgagcattcagtcttctgacctgttccacctctacagggcattttatggcttaaggatgacggcctagaagggaagggagagacttactttggattaaatttacaatgggaaagtgcttaagctgctgcaaagaggaccagagcttccaacgatgttctccagaagatcaagttagtacagacgcccagcatcgtggagcctcttctatttcacaaccaagtatatctcttggtcataaaacatcttattcccctgtaacacataaagtcaatgcagccaaagcaagtagaaggttattatctgtatcaagtccatctttctctgaaagaagatattctttatttgttggatttcaaaaaagaaatgcttccccttactggcaacaaagtagagctaactttgattctgaagaagacacaggcttcactgatataaaatcttcctcagaccattgtggtagctttatttcccgcagaagacgtttctcatcccgtaaactaagtatagtttcctattacaagagtgccattttttttgatcctcaagcaagtggccagaatgtgtttaatctaaatgaaatcgaaatcttttctaaaacttcaagtaatactgatgctaaaaaacatataaccatctctgctcctgaatataacactaaaaattttaagaattttgaaacaaacactacttctccagcctttgggaacactattgatacagcctcctatcaacaaagcacatcatccttcttttctcttgcaagtgatatttcctctcccgatcaacaaaatggaattgccaatgatattcaacaaaggggccaattatgtaaagatttaaaagatttccttcatcctcgtcctgaaagttacagcacagatcattctccaatcatgattccacagcatccctctcaaagtggaactttcccattcctccataaagctggattttcttcatcttataaaaattctggttgctttatcccacctcaaagcgaattaacttcaggcctgtttgaagatgaagactttgctgtcttgtttcaagatgaagacagatcttcacctattgaaattcctaaaataaggtatattacagctaatactgacacagaagaacagagttttccagtccctaaggcatttaacacacgtgtagaggaattaaatttagatgtccttcttcagaaggtagatcatttacgtatgagtgagtctggcaagtcggagagttttgaactacttcgtgaccacaaagaaaagtttagagatgaaatagagtttatgtggcgatttgctcgtgcttatggagacatgtatgaactatctacaaacacacaagaaaagaaacattatgctaatattggaaaaactttaagtgaaagagctattaatagagcacccatgaatggacattgtcatctgtggtatgcagttttgtgtggctatgtatctgagtttgagggtttacaaaacaaaatcaactatgggcacctcttcaaggaacatctagatatagcaatcaaacttttaccagaggaaccctttctatattacctcaaagggagatactgctatactgtctcaaaactgagctggattgagaaaaaaatggctgctactctgtttggaaaaataccatcttcaactgtacaagaagctttacacaatttccttaaggctgaagaactatgccctggttattctaatcccaattacatgtacttagcaaagtgttatactgatcttgaggaaaaccagaatgctttgaagttctgtaatttggctttattgcttcctactgttaccaaagaggagctgtagtctggaagataaagagcctttggtaccgcaagccctgtcatctgtgagtgtggcacagtgaaggcctggagagtcatgacctaggccctgtgaagtcaagtatttttaccaagtaaaaagattggcaataaaacatttccacatagt

SEQ ID NO: 1557 - DNA, 1832 bp, Homo sapiens
gcaattaatgctgaaacacagctagcatacatagcaataacttaggcaaaaaggcaacactcaagcaaaatccttcctggaattaaaatcctgttattaggtcaaccaacttttcttttaactaactaaataaacaacagcaagacatgaaacctagacctataagtttagtacctgaatctcttgctgattcatgcatttctattaatcttctcagtcagatgtttagctcagatctgtcctcttatccaagcttttccaagagtctcctagctacacttctggcatcatgttacaccctacaatccagctcttcacagtctcctgacttctttttaaaagttgcatactatatatacatctctctcttgcttaacattcctcagttattccctagtggacacagaataaagtctagcttcttagcatgttacttgggctccttcagtgccagtccccacaaattcctcactcatcttgcagaagctcccagttttcaatattctcctaaatgctgtggaacctctgtctatgcaggattctaaagatgaggaaaattagtcccttaagactcagcttaagcattgccccttgtgcctttactgttagtttgcccctctgttcttaagagtttattcctggcattgctcttaagggaaggaagtttggcagggccaagagtcctaaacgttagacctttctctctaaacactaacaacattaaaactccattcaagaaggagcaaaagaagccatcatctagaaacaatgttgataaccacagttcctgaacttgggcttgttaaaagactttatctccatgagtatactgaaacacatatttagtttatctcctattatcaagaaagaaatattaaaacttcactgttgaggatcactctgaatatgaaagtgctcaagacaatcaatcaggtctcgagatctagaaattagtataagtactgagtgctaggggaaaaaaattatactcttcaaactacatccctgggagtgttagtgatgtcataattcactgaggatctagaaactacaggatggatacttataaaagataagggaagtatagtgcataggttgctgagaggtggagagaaagttgcttacttttcctgagcctcaactttctgaaaacatagaaacacaattagatgatgagttatgaggtgaaggaggggatgactcagcagcaatgtgccagctccatagtgacttctccaccaagctggagaaggatttgcagcaatggttccagaaccaactgtgtgtatctacaggatgaagatcatttagactatgatcatttagactgtatcacttttgattctttctatgttgcccaggctgatctcagattcctgggctgaagtgatcctcctgcttcagcctccagagcagctgggattacagcagcttcagtgctgaggctaatggcaaaggaaacaccaggggatcagtgagtaagaacttgtcaagggaacaaagtctgaagatggaacggaggaagaggagaaaatcttccaccaaaaaaaatattaaaatctgatcttcaaggaaatactgaatccacatagcactcccctccgctcccttcttaggcacagcattactcaccatctcacagaggagaaacagaaatataaaataaaaagtggaaacaatcattaaaaatacttagccactcccacgtgtcctgggaaactgagaacacagtaactaccaaacaaattacatgatgtcacatgccagatacctaaaggataacatcaccccatcttcagaaacagaagaaaataaaatagcaaaagcaagag

SEQ ID NO: 1558 - DNA, 2112 bp, Homo sapiens
acacacgagatgctggggcttccctggccccgactggctagccacaggcagggctggcaggaggaggccaccgccaccctgcgtgtcccaggagggcacggacagttgagaacgcccataggaacgctgcacagtggagaacgcatgcaggcctccaaccatggccagggccctgcggcgtggccccgtgtctacctgtaaaggtactgggacccaccacctggcaaggaccacgccgggcaggaggagaccaggaggcgacagtcagacagagaagctgaagaaaccagaaggcgtctgtgcaagagagccccacacagacactggaaagaaccagggcaacctgcagaccaactcgaaagacctcccctagggcgacggaaatgagatgaggcaaacagcttcccgaccagagcccatgcaccttccacgtctgtgcagggagctcggggccacatcccgagatgggaaagacaactgaggcttccacaaagaaattacaatgaaacagacactggccaggccagctgaaaatcagtgatggactacggtccaaatcaacgtggaggttccaacaagagaaggacggtggtggggtcaccctaccccagcctgcgagtgccccagagggtgcacaagcaggacagccaccctgttgcagagtgtggtgctttcacaccatgttcaccccacctcagccctctggcccagacgtcggtggctcctctgccaggtgaggtgaggtgaggtgaggtgggagcagacagtggagaaacaccacaaacagcacaggtggtcggccagggccacgagcccttcagctcaccgatgccgagaccccacaatccccacaacaaacctgcaaggtcagaataattgcgcacgtgtacggacgactaagctgaggccccttcctccttcacctccggaatgccacctgagcgcaaaggctttgggacacaaagcactcagcagtcggcagtggaggcacagcccaggatcaagaccctgggcttcctgtcccaggctcctcaacctgcaggcggccacacagcaagaagaccctgggaagttaaagaacgaggcgctcctgcttcccccaccctcaacggccagcaaggacacaaaggcagcccagggcagggccagccgccagccacaaggcccctccagaacccaaggtccagtggagactctgaaagggctgattgcagggcccccacggggtccacacaccagacacagaggcccatgcagaaaggcggtaaggggcccccctggggtctgcacacccgacacagaggccctgcgagagggaggcatggagcgcccgcggtgtcggcacaccaggattcacagcccggctctccacccccagctgacctcgctgtgaagagatggtttgtgctgagagcttagcaaggccgtcgtctaccgagtgcttcccaccacagcccatgcgcaggcatgagagtcatgcctcccgcaggccacagcttcactcatgcaaggacattctgggggccgggacgtcctagccagtggctagaactgggtgtgaccatgggcccccttggctggggagaaaaggaggtgcccctagatcccaagtcccctggggccgcagcaaagggaggaggaccttgcatcactccagggtgccacgtggacgaacagaggtaacattgggagtgtggctggcagtgttggacattcagaacatgtctgcccaaaacaaacatggccttcgcttctcccagctcccagaaacaaagtaaacagaaggatcacgtctggacaccagggaccagcccctgttacatccctgtcccccccaggccagagcctgaccactccgtgtcacctgcctctactcctgtagtgactgtcaactttttggatttcagaaagccaaaccagcaagggaagccttttcccggggggtagaggtgtctctcctacacacacccctaccccagggtctgagatgacatcccaaatcaaacccggtattctgcagagatacacaaaggttcaaactacagacagccttgtatcagctgtaaaggggggccagattttgctgcaaaagaaaaaacccagtatcccctc

SEQ ID NO: 1559 - DNA, 1726 bp, Homo sapiens
gctggtgaattaattcaacaaacattttctggggcaccgacaatctgcccagtgcaccaggctaggtatctgatacaaagataatgaaaacagtctcttggaacctaattggggtcctcatttgaccaggaatttctttcgtcccgttttaagccaaccagttttgtccggacaagacaaaaacaacttgggctgctttagagaagcccagctcagtgtagacaatagctgcccagcctctgaaaggggctgattggattatgtggcaaatggaggtgcaaggatgacttggacggtgacaaatgaagtgggcggagacctgctttgagttaatccaggctattaggaggggaccttttgtcttccagagactggcaggagcttttaccagtggtttttacatccttaatgttcaggacgaataatttatggtcagtgaaaatccaggccccagtgagattcgagtgggctgtaaaatcgagagtcctgctcccagtgagtaatggtagtgaatgtttctgtcactttttgcaaccgtccattcatttgatcctcacaactccctgtcctgagccaggaccggccactgccactcccagggaaacagaggctgtcaagaggctccacagattgggccccactggatcattgaacccctgttccctgagttctagaggaagaattgtacctgtctcagtcccggccacctccagaaggcctccctctgcatttctgactttgctgtgccggcagcctggagcctcccaggtccctgctgtcatcttttctagccactacagtctctgtctttcctttcacagccaagcttcttgaaaggcctgtctacacttgctgtcttccttcctcacctccaatttcctcttcaacccactgcttcctgactcgctctactccgtggaagcacgctcacaaagggctaatctcgggccttgtcgaaggaagaggctgcagacgttaatgaggttagctgctggattccagtattcgtcgcataaggatccttctttgtctgcgaaggaaaaacacactgattatcataatgagttcctgacctggccatcccggggtgcccttgaccagccccgtgcctcctcagggtgtcccagcaccagcctggcacagagtggggctcagttagagtatgtgggatgttggtttcgccaggcacgtgggccgtggcccggctgggtcggctgaagaactgcggatggaagctgcggaagaggccctgatggggcccaccatcccggacccaagtcttcttcctggcgggcctctcgtctccttcctggtttgggcggaagccatcacctggatgcctacgtgggaagggacctcgaatgtgggaccccagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaac

SEQ ID NO: 1560 - DNA, 3133 bp, Homo sapiens
gtgcgctgtggacggaggttgtggagagagcagggcggcattggtggctgcggctgaggcttgagccagagatttaaaaatggacaatgatgattttttttccatggactttaaagatggagtctgtctctgttgtccaggctggagtgcagtggcatgatctcggctcactgcaacctccgcctcctgtgttcaagcgattcttctgcctcagcctcccaagtagctgggactacagaagttgttgaaaacctggttacaaatgataattcacctaacataccagaggcaattgatagactcttcagcgacatagcaaatatcaacagggagtctatggctgaaatagcagacattcagattgaagaaatggcagtaaacctatggaactgggcacttaccataggaggaggttggcttgtaaatgaagagcagaaaattagattacattatgttgcttgcaagttgctgagtatgtgtgaagcctcatttgcctcagaacaaagtattcaacgactgattatgatgaatatgagaataggaaaagaatggttggatgctggaaattttctaatcgctgatgaatgttttcaagctgctgtggccagtctggagcaattatacgtcaaattaattcaaaggagctcccctgaggctgacttgaccatggagaagattactgttgagagtgaccacttcagagtgctttcttaccaagcagagtcagcagttgctcaaggggattttcaaagagcatctatgtgtgtactgcaatgtaaagatatgttgatgaggctcccccagatgacttcaagtcttcatcatctctgttacaactttggagtagaaacccagaagaataataaatatgaagaaagttctttctggcttagccaaagctatgatattgggaagatggataagaaatctactgggccagaaatgctggctaaagttctacggctattagccacgaattatttggattgggatgacaccaaatattatgataaggctctcaatgctgtaaacctagcaaacaaggaacatttaagttctcctgggcttttcttaaaaatgaaaatcctcttgaaaggcgaaacatctaatgaagaactccttgaagctgtcatggaaatactacatcttgacatgcccttagacttctgtctgaacattgctaaactgctgatggatcatgaaagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttagctcaccaaacaggaagacaactgacagcagaatcaatgaactggttacacaacattctgtggagacaagctgccagtagttttgaggtacaaaattacactgatgccctacaatggtactattattctctgaggttttattcaactgatgaaatggatctggacttcaccaagctgcagaggaacatggcttgctgttacctgaatttgcaacaacttgataaggccaaagaggcagtggcagaagctgaacgacatgaccctaggaacgttttcactcaattttatatattcaagattgcagtcatagagggcaactctgaaagagctttgcaggcaataattactttagagaatatattaacagatgaagagtcagaagataatgatctagttgcagagagaggttcacctaccatgcttctaagtttagctgcccagtttgctctagagaatggacaacaaattgtggcagaaaaagctttggaatatttagctcaacattcagaagaccaggaacaagttcttacagctgtaaagtgtttgcttcgttttcttcttccaaaaattgctgaaatgccggaatctgaagataagaagaaagaaatggatcgacttttgacttgcctgaatagagcctttgtgaaactttctcagccttttggtgaagaagccttaagtttggagtcaagagctaatgaagctcagtggtttcgaaaaacagcttggaacttggctgtgcaatgtgacaaagatccagtgatgatgagagagttttttatactttcttataagatgtcccagttttgtccttctgatcaagtaattctgattgcacggaaaacatgtttacttatggcagttgcagttgatctagagcaagggagaaaagcttcaacagcttttgaacagaccatgttcctgagtcgtgcacttgaggagatccagacatgcaatgacatccataatttcctgaaacaaacagggaccttctcaaatgattcatgtgagaaattgcttctgctgtacgagtttgaagttagagccaaattgaatgatccattactggaaagcttcctggaatcagtgtgggagttgcctcatttagaaactaaaacatttgaaacaattgcaataatagcaatggaaaagcctgcacactatcctttgattgctctcaaggccttgaaaaaggctttattgctctacaaaaaggaagaaccaattgatatatcacaatacagcaaatgtatgcacaacttggttaacctctcagtgccagatggggcgtcgaatgtagagctctgtcccctggaagaagtttggggctattttgaagatgctctgagccacattagccgcactaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaattt

SEQ ID NO: 1561 - DNA, 2189 bp, Homo sapiens
tccgaccctttgagccgtggccgttgccagatgtccacaatgggaaacgaggccagttacccggcggagatgtgctcccactttgacaatgatgaaattaaaaggctgggcaggaggtttaagaagttggacttggacaaatcagggtctctgagcgtggaggagttcatgtccctgccggagctgcgccacaacccgttggtgcggcgagtgatcgacgtcttcgacaccgacggtgatggagaagtggacttcaaggaattcatcctggggacctcccagttcagcgtcaagggcgacgaggagcagaagttgaggtttgcgttcagcatttacgacatggataaagatggctacatttccaacggggagctcttccaggtgctgaagatgatggtgggcaacaacctgacggactggcagctccagcagctggtcgacaaaaccatcatcatcctggacaaggatggcgatgggaagatatcctttgaggaattcagtgctgtggtcagagacctggagatccacaagaagctggtcctcatcgtatgagcctttttcttacaagcaccacccaacaacttctgctttcttccctatctctttcaagatttgctcaagacgtccaactgtctctctgacttatctggaagtatttctttttgtgaagccatatgtcctaacaggagcttcattaccaactcagtgctattaattctccttctctgaatgactcagggtaccctatagggggaagagcaagtcaaatgagcatagtggggaaagaaaaggaaatggcttttataaacatcttttactttgttttgattcaaagaccaaactagaactttaaaagttcaaaaataaggaagtatacatttttgctgttatttctcatcattttgtatatgggaggaaatttataatttgcatgggtgttaggtgaactgttttcatttgcttgtgttcagatatcttgccagattgttaacttcctattgtagcaacagggacaaatatatttgtctttgctgggcatctcgtaatcacttttcttaggggacagaatcccatcttttccttcggcagattgcagccccattccccacaatgcatccagaaatcgctgtgcatgtttgaggggtaggagttcatttggcctcctcctgacttgttgctccagctcctgaacagaaactagcttcagggctcttataggaaatgctaagcctggactaagtgcccagctcagccatcatcctcattagcagtgggtttccagggttggcagcccacaccagcattaatttcaatgaaggggacctccagctaaatagggcaagcaaagtgttctcccagaaagtgctctcacctccgacactggtccctacccccaggtggagacaatgagacatttagttagttgtcctacggaggagaggcagtagagtcaggctgcagtggaatctccctaggatgccaaagtggcattatgtctgttgctcacagatgcagagactgacaattgtgtctccacagcagaggtggatgctagctacaccagctatgctgattttgaaaatcagatctgaggcctagaagagaaactgagagctctctcattccaggaagccttttccctagtggaacattcagtgcagaagtcctcacacactaacagatctccaccattgggtgagccggagcctgtggttccaggggagatccagaatgcatgtgtctcttcccacgcatttatgtcatgttggtagctttagatcagccatggcgagaaaagaacaaaagcttttagttgtttttgttttgttttggagaatttgtttaccagtaaatacatcactgcctgtaccccaaatgttaccagctccctgaggtgtcccacatactattgtgagttctcagagcatgaactgtcctcagaagagcagggctaggacttgtcccagcatctgtgcctccataccaatcctcttcctcacagagaaccgcttcccatataagatgcttaaggctctcaaaacagcagaacaatgaaacatactctccctacacttgcttagccaagagataccactcaggtaacttttttcaggacatggaagatctgtttcaaggagatttactgctattttatttggaagaagctggcaactggtcttgaccaaaat

SEQ ID NO: 1562 - DNA, 2212 bp, Homo sapiens
gagagaaagggcctaggacagaacccaaggaacacccacgtttggggagcaggagggaaatgaggctcctgaggacaggtaggttctgatgttcatacgttttttcagtccaccttgctaatcccagctatagcaagcatttggggctggctttgccagactcgccaaccctcctgtttccacagccccagtctgctctcagcttagggctgtagccagccctcttccctgccatggtttatatgatgtccaccaagccaccgtgcacaggaagggtctcagcaaaatcactcttggataagtgtcaggagcagaagtggcttgaattagaaacggcttccacagggaggagctggggcccttgggcaagtcatgtcgattctctgggcctcagtttttctttctgtatgtggggacgatggtgttcatcccaccgggctgtgggaaaattagatgtgatcacatgtgtgagccagagagacttcagtggtgtctaacaacaaatgccgcaccttggttctcaggagaaatgtgaagcgtcccctctttatgcctgtttgaaacctgattctcttgccaggtgtccatccctcaggggacagtgggtgaccccaagcccataacaacagtgactgctcctgaagggaatcttggacatgcacacacacgtgcacacatgtacagtatgcctggggtccacccttgccagttcagtcttgattagatccagttgaatgctggccagcgaccttctgagtgaagcagaagctgccggcccagcccctcgggggagccagtgagatgtgatgccgcgtctttcttcataaacagaggagcggagcatgcccactgcaggatcagtgtccctgcaggttctctctcattctctacatcagggcaccccgcaccacacagatgcatggggccagaaccaaagcgcaagtgagcgatccctgcggggatctcccagaacaaactagaagcaaaatctgcctcttcctgaggacaacatgcatttttccaggcctttcaaagcaaggcaggtcaattgagttataattggctctctaattagaactgccacaagctgttaaattctttacctgctgcctgatatattacacaaaggtgacaaatctgcttctgcctttgcaatgatcaaagaaagccagctagaatctcaccttccttgccgccagcagcccccaccagctacccttactgccactcagacgcccacacacccaccagcaagtatgacatggacacagcccagtttacaaggaaattggctgtagggaaatcaagctcagaaggctgtgttgctgagccaccgtttggagcctgaatgggaggagacagagccttctcatttttctagatgtgggaagtgttctgaggatgtttcaatgatgctttgagcctctcctcgttccattgttctgtgatagaagaaaatgtatctcctttccctttctgaatcctcaacactgaaaaggatagtatttttgtgttgctcccctcaaccatcaagacgacagtgtgctttggatgatgggatcagtgtgttttgtgacatccagtgtcacctgtgtcttctgtgttgtctctgctctagtgccagtgcctcttgcaggtcctgctggttcacgcttgcatgcagtgcagctgatgccagtatgtcccttcctctcacctctccctggctccacccacaatgacatcacctcggtagcttggaatcggccatggtggaagtgtttataccacggaaattggcaggcgccacaaatcaaggcctttttctctttcagagaggcagtttgctgacaccactggactcagatggtttgaactgtgatgggggaaaggcaggcacaggagacgggagcagagtcaggagagcaccggacattggcagagaagaacggtgccaaatggccctaacccggggctcctggggcacatggcgcttgtggcacagatctgatggaggttctctgccattccagagggacaggggccaagggggaaggaacgagccctggaattgcccaggatggtggcaggaagggtagcacggtgggggagcgcgcgttgtggagcaaaagagccccttgtttgaattctagctctgccatacactggcagtttgtaggaccttggccatgtggccgtgtgatttaacctctgtaatacagaagtgaattcc

SEQ ID NO: 1563 - DNA, 1953 bp, Homo sapiens
gattggtatctggtcagcagagaaaggcatccaggccccgccaggagagacggtgcctcgctctgttgcccagactggagtgcagtggtgtgatcataactcagtatagcctagaactcctgagctcaagcaatcctcccacctcagcctttcaagcagctaggagtacagttgggagccactgtacctggttactgtcacgggatcacctgcctttttggctgctgcacctgaacagagtcatcatgcctcgaggtcaggagagtaaactccgtgccagggaaaaacgccgtcaggcccgaggagggctggaagatttgatagatgctctggacattttagaagaggaggaagaatctcccccctctgcctctgcttgtttgaaggatgtttcccagagttcacttgatggggcatccaacaatccccatggacttcaggaagcccgatccaccagcacatctgctacagctgcttcacacacaagacatcccgaaggagtcaacgaccaaatggaagaaaggccaatatgcacacaagatctagaagccactgatagctttcccagaggccctgtagatgagaaagtaattatattggtgcattacttgctgtacaagtaccaaatgaaagagcccattacaaaggcagatatgctgagaaatgtaacccaaatgtccaagagccagttccctgtaatcctgagcagagcttctgagcacctggagctgatccttggtcttgacctgaaggaagtggagcctaataagcacatctatgtccttgtcaacaaactagatctaggctgtgatgcaaagctgagtgatgaaacaggcgtgcccaagactggcctgctgatgactgtcctgggtattatcttcacaaatggcaattgtgtcgctgaggaggaagtctggaaagtgtttaacacgatggggttatatgacggaattgagcacttcatgtttggggagcccaggaagctccttaccaaagatttggtgaaagaaaattacctggagtaccagcaagtgcccaacagtgatcctccacgctatcaattcctatggggcccaagagcccatgctgaaaccagcaagatgaaagttcttgagtttttggccaaggtaaatgatacagctcccagtgaattctcaaactggtatacagaggctttacaagatgaggaagagagagccagagccagagttgcagccaaggctcgcgttagtgccacagccggtgcacgttccaaggttaagtccagcaagtcctcccaactgcagtaaagtctgagggagattcttcatttgtgtttgaaaagaaatgcacattctgagctgtgggaggtcagggtgggactggagacaacacagtgaataatatgtttgtgttaatgttctatgtgatggcttggaatttttgaagatgttgttcctttaatagatggttaaagtagcttcactatctaagtttatgaatgacattgctcaaatttttctgtatgtgagattaagagtaagcgatttattgctttataagtctaattgggaaactctccatttatttagtgatcgaaacacgatagcatggtagtaaattaggcatttcctaattcaatgtgaaataatttaggagtgtaataaatgggatcaagaaatagagcaaagagggtcgggtgcggtggctcacacctgtagtcctagcactttgggaggccgaggcgggcggatcatgaggtcaggagatcaagaccatcttggctaacacagtgaagccccgtctctgctaaaagtacaaaaaattggccaggcgtggtggcgggttcctgtggtcctagctgctcaggaggctgaggcaggagaatggcgtaaacccgggaggcggagcttgcagtgagccaagatcacacgactgcattccagcctgggtgacagagcgagactctgtctc

SEQ ID NO: 1564 - DNA, 2350 bp, Homo sapiens
agccgtggtggttatggctggtctgagcggcgcgcagatccccgacggggagtttaccgcgctagtgtaccggctcatccgcgatgcccgctacgccgaggcggtgcagctgctgggccagctgcacccggaactggagcagtaccgcctgtaccaggcccaggccctgtacaaggcctgcctttatccggaggccactcgggtcgccttccttctcctggataaccccgcctaccacagccgggtcctccgcctgcaagctgccatcaagtatagcgagggcgatctgccagggtccaggagcctggtggagcagctgctgagtggggaagggggagaagaaagtggaggcgacaatgagaccgatggccaggtcaacctgggttgtttgctctacaaggagggacagtatgaagctgcatgctccaagttttctgccacactgcaggcctcgggctaccagcctgacctttcctacaacctggctttggcctattacagcagccgacagtatgcctcagcactgaagcatatcgctgagattattgagcgtggcatccgccagcatcctgagctaggtgtgggcatgaccaccgagggctttgatgttcgcagtgttggcaacaccttagttctccatcagactgctctggtggaagccttcaaccttaaggcagccatagaataccaactgagaagctatgaggtagctcaagaaaccctcaccgacatgccacccagggcagaggaagagttggaccctgtgaccctgcacaaccaggcactaatgaacatggatgccaggcctacagaagggtttgaaaagctacagtttttgctccaacagaatccctttcctccagagacttttggcaacctgttgctgctctactgtaaatatgagtattttgacctggcagcagatgtcctggcagaaaatgcccatttgacgtataagttcctcacaccctatctctatgacttcttagatgccctgatcacttgccagacagctcctgaagaggctttcattaagcttgatgggctagcagggatgctgactgagcagcttcggagactcaccaagcaagtacaggaagcaagacacaacagagatgatgaagctatcaaaaaggcagtgaatgaatatgatgaaaccatggagaaatacattcctgtgttgatggctcaggcaaaaatctactggaatcttgaaaattatccaatggtggaaaagatcttccgcaaatctgtggaattctgtaacgaccatgatgtgtggaagttgaatgtggctcatgttctgttcatgcaggaaaacaaatacaaagaagccattggtttctatgaacccatagtcaagaagcattatgataacatcctgaatgtcagtgctattgtactggctaatctctgtgtttcctatattatgacaagtcaaaatgaagaagcagaggagttgatgaggaagattgaaaaggaggaagagcagctctcttatgatgacccaaataggaaaatgtaccatctctgcattgtgaatttggtgataggaactctttattgtgccaaaggaaactatgagtttggtatttctcgagttatcaaaagcttggagccttataataaaaagctgggaacagatacctggtattatgccaaaagatgcttcctgtccttgttagaaaacatgtcaaaacacatgatagtcattcatgacagtgttattcaagaatgtgtccagcttttaggacactgtgaactttatggcacaaacatacctgctgttattgaacaacccctcgaagaagaaagaatgcatgttgggaagaatacagtcacagatgagtccagacaattgaaagctttgatttatgagattataggatggaataagtagttatgactgatagtggcttttttcaaaatggctttcttacgtaccacacttttttttatctgtatttagccttggcatctttatatttgtcttattttgaatcttatccactttgtaagaacaagtttatgtttgagcaactttttcatttaatccagaagggtagggactatgcagtgtaagctgcatcacttctgctttcttcctactagtgacaatcatctggtcttgccctcaagcaacaattgctagagtaacatctttgtataagcaagtaaccccagatagagttgacgtttcagctttgggctgtcaaaagggtatgtcatggaccaaagcactgttagtacgggtatgtttgcatttggtcactgatatgtaaatgactgctagcccacggctggaccacttctcaatcagcaaataaagccatgtctattttgctatctc

SEQ ID NO: 1565 - DNA, 1995 bp, Homo sapiens
tgcctttcctgagaagctccctcatgtgtttgctgttacttttaatggattgcttcctgatacatgggaggcccaggcacttgcccttcaatctggccaactgcagcctgacctgggtggaattggagctgcctgaggaacacttagaccaggcacttggcaatatgactcacttttttcccctaaaagttagtctgtaaagagcaactggaaatgttcctgtttacatctttgtggagtgtaattttaatcaggattctcaaggtttttcacttcaattctctgaatttttaagatcttaaatgccctgtggtcacagtatttggccctgtacttctgagggctacgtggaaaatgcttgatgatcattactgacttgtcaatagtaattatgccaataaacagaaaagtcttccagttctggtctgttgaggccctgccgttaagccatggttttcccaaaggctctgcagtgggttctcatgggatgtctttcattggttctttctctcccttttcctcagagggtcgcatttcctgttttgtgcaggaaattcccactgttttgggttccccagctacagtcggaaagacatcagagtgttcaaggcggagtccaggcctgagatctcagcaggccagacaggcagcagatgcttgttgcttttcttgtgttatatttttcgttcccttacttagcatttgtgggaccaaagccaacaaacaacaggttgttaaaagaatgagagtaatttgacttccgacagtgattggggctcggggttgttgggtgttttgttttctgatttgaaactagctgtatggtaaccactaactctcgccttattcttttcttgcagatgagctcacagtgcctgcactttaccccagtagccctgaagtgtgggccccgtaccctctgtacccagcggagttagcgcctgctctacctcctcctgctttcacctatcccgcttcactgcatgcccaggtaattgatacccatcggccaggacttcactcacttcaccaccagtcctttcaaacttggttcccgagagcacaccatacaactaacacctatccagctaacagatccaccctcaagagattaatgatcccctctaaatcaagctgacactccttcaggactgacgaggatcgtctgacagcaatgatatcacccactgcctgatgtttgccccaaatgacacctctctcttccttaatgatctcacctcatatcgcacatgagagaccggggcaggtttatccacctggctcccagctagctagagggcatcaccagagtgtatacgtgtgtgccttgtgtggaagggctgcagaggaaggtgtgtgctaggagaaggggatatgtgcgtctgtgcgtgtttctgtgtgttgagagttttccactctcgtgtacggtgagaagaatctctgaccaaagggaaagcttccaggggggaaggctgtactttcttaaatatgttacaggaaagattaagggttccttctctccattttcaggaaaccctgtagaaaaggagatacaagatagtgtctaagatggaattacaggtcaaggtagagatctctattctgaccagctttctttcttagttaaaaatagcctgatttttataaacaaacttcctgtttctccgcaaagattactgtctacatactaacacttcctctccccttggagaaaatatttctcttagcttcgcttttagtgcaagtggtagtaatcagtgtaaagattcacctctggagatcaccactcattctttggcctgcaaagattgatgaccagtaacaaatagaaagtacgtacgtaggtttcatttgtctttctgcatgtgtaattcagcctttaaattttaaatttttaaaaattattaggctggacaggcagagttttcgtttgcctgttttgctcagtgtttgtttacaaggctgggtgaaataaacagcttcccagaaaacctc

SEQ ID NO: 1566 - DNA, 2072 bp, Homo sapiens
ggccttcttccacctatagacagagtctacgcaggggtcttggaacccgggcacaccagtccccagctaacgaaatccccgagttgggggatttgagagggtcacgtttggcccaagaacccgcagtcctctttggtcttcggccctctatttctaagcgtgggcttctggcacggcggctctgggcacagcccatgctgctttcgggctgggtggtttcaacgacgacaacaattatcacagtgacggtgaccttcaccccaacaggactgctgtgtgtgaagcactcaagagggcccctacaaccaacctgccaggagtcggctcctgaaaacagggtcggaaaaggtcagtgcccatcagaatcgagctgtcggcaaaaagctggagaggttaggagctttgtctatctcaagggcaacaaactgctttgaccctgagggctctgaagacgagtttccctcaccgcagctctcaagacaacagggatcagactcagaaagacactgcctgtataaggctcttgtttgtcttgtttttaattcctgccctctgcctccagatctcagtcctctatctgtgaaacggaattcggccttgcctgtccacgaaatgaagacaaggcatctcgtgtgtgttaagatgaaacaagatcttagcaagagagtaatgatttcttttctaaaacattttttactgtagtaaaatgtactataacgtaaaattaccatttcaatcatttgtaagttcagtggcattaagtacattcacattgtcgggcagctgtcagaggtgttcgaaccagagcgactccatcttgaacaggcgctgcgcaaaatgaggctgagacctgctgggctgcattcccaggaggttaggcattcttcgtcacaggatgagtcagtggctgccagggaggcaggggtctggcactcttcctcatgcttacgagatggctgctggaattccaggaatcacatgcaaattctagtcaggagcaaagaggaagagacacagtgaaaaggggtatacagcggcagaaggaagctcctcaaatgaactctgctagaactctagccagtagcttctccttctatcacagtggccagaactgtgacaagtgaccatccttaggggaaaaaagatgctgagaaatgtgaattttgttgccaccttacattttcaaaggagttccattcgtaagtacagaacgctcagagaagaggcagcagatctaggatatggagcagcagctcttaagggcacagtgggaaggtttcaagactgaggaggatcttggatttgggtaggggaaggcagttcacagtattgtggaggaaatgctgtgaaagagaaagtggaaggcatggaagcttaaacttttaatatgactggtgaatacaaggatgaagggcaaagggaattcagactcatggtggtcagattaagaccttcagcggctctgtctcccagccccacatacccacttccatgttctgctctttactgaagctgaaagtctgcaaccttcattctctgactcccttacattttcttaggcttcttgctagcttctgccaaaaagaggccctggcaggagattagatggcaggaggcagaggtaaggattccatgttaacaggtgctggaagttgctggtgtggcaatgagaactgggccccggtcaaggcagcactactttggtagatccagaatcaaccatgataaccgtgacagtgtcttcaacagtgcagcagtagacacaggcccctggtgccggaatccaatacagggacaggagcagcacggagtcacggaacaccgtcttgccttcatgtcactttaccatttcttctttctccctcttactctaccagctacctgtggagatgttgaaccttttatctgtcgctgtctgcttaggaacagaagaaaaggcagctcattgcttgactcagctttcagcttgatttttttcctttggcagagtgaattggggtcccaggtgttcattttccttttgtagtacctttcctcagcatgcaattaatacaaaaagaacaataaacctt

SEQ ID NO: 1567 - DNA, 1816 bp, Homo sapiens
tgtcaaattaattgagagtcagatacagaccaatgagaatctcataccaaaatcgcctgtggaagactcacctcaaataagcatcacagatataaaaatgacctccccacctgcttacaaagttggtgacaagatagctactcagaaaacatatggtttggctctggctaaactgggccgtgcaaatgaaagagttattgttctgagtggtgacacgatgaactccaccttttctgagatattcaggaaagaacaccctgagcgtttcatagagtgtattattgctgaacaaaacatggtaagtgtggcactaggctgtgctacacgtggtcgaaccattgcttttgctggtgcttttgctgccttttttactagagcattcgatcagctccgaatgggagccatttctcaagccaatatcaaccttattggttcccactgtggggtatccactggagaagatggagtctcccagatggccctggaggatctagccatgttccgaagcattcccaattgtactgttttctatccaagtgatgccatctcgacagagcatgctatttatctagccgccaataccaagggaatgtgcttcattcgaaccagccaaccagaaactgcagttatttataccccacaagaaaattttgagattggccaggccaaggtggtccgccacggtgtcaatgataaagtcacagtaattggagctggagttactctccatgaagccttagaagctgctgaccatctttctcaacaaggtatttctgtccgtgtcatcgacccatttaccattaaacccctggatgccgccaccatcatctccagtgcaaaagccacaggcggccgagttatcacagtggaggatcactacagggaaggtggcattggagaagctgtttgtgcagctgtctccagggagcctgatatccttgttcatcaactggcagtgtcaggagtgcctcaacgtgggaaaactagtgaattgctggatatgtttggaatcagtaccagacacattatagcagccgtaacacttactttaatgaagtaaactaggcttatttctaaaaagtcaagtctattggctttggcccaaaagcactggtatctttgtattaaattcatgtttattgtcacaaaaccattatttatacctatacagttgtactgtttcttttaaagcaaagccatttaacatctttcttcattcctaatttggaaattaaagtttacctttctgttaatctatgtataaatgttactctgagttattaatgtggattttaaaattgtaagcaatagaataggaaataaaacaactacctaatacaaatatttctgataagactacaaatatctgactgagctggggattaaagtagaggtaactgtatcttaaatgagtatgatttccttgtaagttaaaaaaattgaaatttaattgtagacttcaatagtccaagttttgaaggatgtttgagcttttgtataatgccatttatacctgcagttttacagataatgtttgactgcagttgccttggaaattcctccaaagtttgccttcatctctcctctacagtttggaggtgatggtgcagcagtggaacatctcttgatgcaccacactacttgtgttctgtgaagtgatgaaagtataactggttctagtttgcacactacacacatagttttgtgaagcttcagaaatgttttttcttttccttgtggccaaaccagtttgttaatctgattatattcatctgctaatgatactaaagttaatgtaataaagcatttaaaaatc

SEQ ID NO: 1568 - DNA, 1743 bp, Homo sapiens
cttacgtgaactgctaattggagtctgatgttcttggcccccaaacagtcagaaatgacagctcccgctccagcagctgggcttcctggggagggagtgcagccgggcagggcaggctcatcccctgaccagaaagcatactcgtgcccactggctcagaggccctggccgccggccggatggtgccccggggacctgaggcgagcaggagctctcctgtaattcccagagcacccgctgccctcagctgtgcctgtgagtggacaaggccaggctgggtgtgcactggggcagtgtggggcgcagacaggggcccctgcagggagcggctctaccactgtccctcaggcgttctccaaggctgggggctatttcccagggccctgccgtaaggccccgagctctcctctgggagccacacctgccaagccacgcgcacacggcacatttgcactggcgcactaaggctggcagacccaccctgatgacggcacctgtcctccctggacagtcacacggaaaacctgggcctcggcctaggggagctgggaccacgacttctggggccagtttctacttgggctgcctggaaggaaagctgtggccccaaggggcttcacagccgccttaagagcttttttggcttcagtggtttggcatctgccactcctctggccagcagcggggcctggctgagggcagcccaaccctcagccagccccacaggcctgtctgggcagcttgccccgggtgtgtgcacatgggtggccacagggcttctcaagcaagccctagggtagtgtggccagggacactcaagatccaggggtatgtgcagggtggaaggtcttatcagggtgcccatggcccagcacagcaggggcgagtctaggctgaggaccccaatggtcaagagagcccacgagactggcaccggccctcacatgcccatctctcctgatgaggccacggtgagccctggagctgctcatcaggcccctcacctctgttccccacagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctctttttgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaatggtc

SEQ ID NO: 1569 - DNA, 2024 bp, Homo sapiens
attttcctcaaagcccaagaaaaacaccagcagctggtcctggccttggagcgcaacgggactatcaaaatgatccagggtaaggaagatgatatctacctcatggtgatctgggagctgcctgatgttgtgcctttcctacaagatgggaaacatgctgtgcatctgagaatgtctactagagacaggaacatggctattcctttcccagatgtcgagttgatagttgagaggaacttttctcaacctactgataatcccaccatggatttattacgagtgaactgcattgatttactacaagtagaaggatataatttgatagcagctggaaccttaaatggtgtgatcatcttatggaattttgtgacgtctactgtcaaaaaagtgtaccgacctgaagattgcttcactgtaaaccctgacttgcattccaagcactttaaaattaatgacatactgttcctctttcgtacccctgaatgtgcaaggagatcaagtcaggattccatatgttcttcatcccagtgtgaatccagcaaaggtccacagagcagtaagggaagcaagcaaagcatacatgacagtgaggttaaaggtgaacaaacagatgtaatggtgggaaagcaacagccaatggacaaaaaacaccctggaattgccaatttaccagaagcccagccacctatccttgtcactgctcatgaggatggacacctccgcttgtggactctggagggaagactactgaaagatatgctacctttcacaaaacattctgccatttctctgacatcgctgtatactgattcatgtacgaggatactactggctggaaatgtggaaggacatgttatcctttgcaatattagctctttcctggatccacctcatgatgaaaagaaattcaagcagctgctttcctggcgtgctcattctttggaaattattcaagtaatctatgtagaagaaaaacaagtggtacttactgcctccatcgatggctcagtaaggctctggcatgccctcaatggacattattgtggatattttggacagcgaaggctctttgaattatcacagacaagagatttcattttgccttgtgatgttactgaatatcccatagaaataaaagaagaaagcaagttcacagagaagcaaaaatatgaatatcctctgatatttgaccgggaaaaatggagaaaaatgagctcagtgtctctacttttcaaacgcacacctcccaaggcctttgaagtggaacaggatttcaagtttttcaagtctctttcttctcctaagattcgaagatatcccttggaaggtttcgtgactgaaaacagagaggcagggattgttttcggctctctgcctatatacagtatatcaagccccactagtctaagatttcttccactgattggcgtagaagcccaaaaggactcttcagatggcattacaggaaagaagaagggaggtcatgttcaacgtgaaaaagcaccacgaagaagaagtttgaaaaaaaatttagtcccacaaataaatctggcttcttccttcttcccagctatacccaagtaaggagaaaaaatcagaaatggctgctgcacataaaatggcaatgtttggatgatacctgctctttatttcaggatgagagggagaaaccaccagacactatcggtcatctctggtgtcaggccatcctattgatgggaaagattgcttagggagttctggtgaccttaactctgaataccaagcaagcagcaagcagccagaagtttaggcggtgtttcttatttactgtcagcaaactgacacataagaaaacaaatgaaatcaacagcattagtaggtctaaaataatatggttatcaatgtttagctttccacttcctcccattggtcaccttactccacagcaagaatgactgtcagaacatgtgcagtaaaaggcactttcaagtcatgctatgtgttgtacaaaaagaattattaaaaagaaaaatgtaccagtc

SEQ ID NO: 1570 - DNA, 2021 bp, Homo sapiens
agaagtcctgtagggagatgggcagttaccttctctccgtctctctctcggggactctatttgtggctggtggagctgtcttaaacgaagagaaccatgagcaatgaatcttgtttaccttattacacagcccacagctactcttcaatgagtgcgttcaaaacctccatgggggacctgcaacgacaattgtacaacagaggagagtacaacattttcaagtatgcaccaatgttcgagagtaattttattcagataaacaaaaagggagaggtgattgatgtacacaaccgtgtccgaatggtgacagtgggcatcgtctgcaccagccccatcctcccactgcctgacgtcatggttctggcccaaccaactaaaatctgtgaacagcatgtcagatggggccggtttgccaaggggagaggtcgcaggcccgtcaagactctagagctcacgagactgcttcccttgaaatttgtgaagatctccatccacgatcatgagaaacagcagctgcgcctgaaactcgccactggccgtactttttatctgcagttgtgtccctcttctgacacacgggaagatctcttttgctattgggaaaaacttgtctatctcctgaggccaccagtagagagttactgcagtaccccaacacttctatctggggacgcaccacccgaagacaacaaaagcctagtggctgcagagctccacagagaaggggatcagagtgagactgggctctacaagccttgtgatgtatctgcagccacctcttctgcttatgctgggggagagggaatccaacatgcctcccacggaacggctagtgcggcttctccatccacgagcactccaggggctgctgaaggaggagcagcaaggacagcaggtggcatggcagtggcaggaacagcaacaggacctagaacagatgtggcaatagcaggggcagcaatgagtcctgcaacaggtgctatgagcatagcaacaaccaaatctgcaggcccaggccaagtgaccacagcgctggcgggagcagctatcaaaaatccaggagaaaatgaatccagcaagtccatggcaggtgctgccaacatatcctcagagggtattagcttggccttggtgggtgctgcaagcacctccttggaaggtacttccacctcgatggcgggggccgccagtctctcccaagacagcagcttgagtgcggcgtttgcaggcagtattacgaccagcaagtgtgcagcagaaagaactgaaggaccagcagtgggacccctcatctccaccttgcaaagcgaaggctacatgagtgaacgagatggaagccagaaagtttcccagcccagtgctgaagtctggaatgaaaacaaggaaagaagagaaaagaaggacagacatcccagtaggaaaagttctcatcaccgcaaggcaggtgaaagtcaccgcaggagagcgggggacaagaatcagaaagcgtcttcccaccggtccgcatctggccataaaaacacgagagatgacaaaaaagaaaaagggtacagcaacgtaaggggcaagcgacatggctcctctcgcaagagctccacccacagctccaccaaaaaggagtcgagaacaactcaggaactggggaagaaccaatctgcatctagcacaggagctttacaaaagaaagccagtaagatcagctcttttttaaggagcctcagggccactcctggttcaaaaacaagggtcacatcacatgacagagaggtagatatcgtggctaagacggtggagaagcaaaacatagaggccaaagtggagaaagcccagggtggccaggagctggagatgatcagtggcactatgacatccgagaagacggagatgatcgtctttgaaaccaaatccatttaaagaggagccagggctacaaccgcccagggatctggaagtatccctagaggagcccatcccagctttctttactgcagttcaaataataaaggaaatcgtacaactcc

SEQ ID NO: 1571 - DNA, 2631 bp, Homo sapiens
atattggaaaggcgccgccgccgcctccgccttggagctcggggtgtttcggggactgcggccacaggcaggaaggcgctcctctcctgccccgccgacgcccggccagcccgcttcgccctgacctgtttcctcatgactgcccccggccctgctgccgacggacgtcgccccggcgtccggatttaacacggaaacccggatcggaggccgcgcggggaggaggagggcgacccggtcggtcctgcgaccctctcggcccggctcggcgcctcggcgggagccatgacctcgctgacccagcgcagctccggcctggtgcagcggcgcaccgaggcctcccgcaacggcgccggcagcagcgaggacgagcaggacgacgacgacaagggcgactccaaggaaacgcggctgaccctgatggaggaagtgctcctgctgggcctcaaggaccgcgagggttacacatcattttggaatgactgtatatcatctggattacgtggctgtatgttaattgaattagcattgagaggaaggttacaactagaggcttgtggaatgagacgtaaaagtctattaacaagaaaggtaatctgtaagtcagatgctccaacaggggatgttcttcttgatgaagctctgaagcatgttaaggaaactcagcctccagaaacggtccagaactggattgaattacttagtggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatcccctttttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctgaatcag

SEQ ID NO: 1572 - DNA, 1887 bp, Homo sapiens
acacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccaggtgagtccttcaccactgtcaccctgccctgctcacaccccttctcaagccagacccctccacccacctcacattccaccaccggcctttgatccccaatccctaccactgggcatcaagccacagatgcagcctttcatatattccatgcctcagtttacccatctgcctgcctaacagcagacaatctgggagacctcctcagtattttgagaccccagggaatcactcacttgttcttagacttctccctttccaggcccatccttgagtccggactccctccccaaccctgacggggcggctttggctatgtgtacatggtgcaagtgcacacgtgtgagcgcctgcacgtgagtatgcgtgtgtctggcttcacacacacacctgctgagcatgcctgcgtgccagtgtctctgtgaggtgggggcctgggagtacttgtgtgattgaatattgggctccagtttttcttaccttgctcttgtggtttaaaatggcacgtgccggccgggcgcggtggctcacgcctgtaatcccagcactttgggaggctgagcggggccgatcgcctgaactcaggagttcgagaccagcctggccaacatggtgaaaccccgtcactactgaaaatacaaaattttagccgggtgtggtggcacatacctgtagtcccagctacctgggaggctgagggagaagaatcacttgaacctgggaggtggaggctgcagtgagctgagatcgtaccactgcactccagcctgggcgacgaacggcgtgagactctctctaaataaataaataaataaaaatagaatgacacttgccactgggcaggtgtgccctggacgagggaccccagtgcccaggcctcacctaccacttcagcatttctttcccatcccccacccccatcccagagagctttgggggctgggggaggggccatgcaacagcctcacaggtgcttcctgctcaaacggctctcttgccactttattttccccagagactctgctcctatcctccccacctccccctaactgagcagcagtcctgaggccctgcctcccagtccctccttgttccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctacccccctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctc

SEQ ID NO: 1573 - DNA, 2131 bp, Homo sapiens
actggcgggactgcgcggcggcgactacagacgtgtcgggggtccggggcctgtcgcggttgccaagcgctcggcgcttggcgctggcgctggccaaggcgtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccaggtcacacactgttgcagcgcaggtagaaaattatggcatgccgtttagcagaactgaagatgggaagatttatcagcgtgcatttggcggacacagcctcaagtttggaaagggcaggcaggcccatcggtgctgctgtgtggctgatcggaccggccactcaatattgcacaccttatatgggaggtctctgcgatatgataccagctgttttgtggagtattttgccttggatctcctgatggagaatggggagtgccgtggtgtcttcgcactgtgcatacaggacgggtccatccatcgcataagagcaaagaatactattgttgccacagggctacgggcgcacctacttgagctgcacgtctgcccacaccagcaccagcgacggcacggccatgatcaccagggcaggccttccttgccaggacctcgagtttgttcagttccaccccacaggcacatatggtgctggttgtctcattacggaaggatgtcgtggagagggaggcattctcattaacagtcaaggcgaaaggtttatggagcgatacgcccccatcgcgaaggacctggcgtctagagatgtggtgtctcggtggatggctctggagatccgcgaaggaagaggctgtggccctgagaaagatcacgtctacctgcagctgcaccacctacctccagagcagctggccatgcccttgcccggcatttcagagacagccatgatcttcgctggtgtggacgtcacgaaggagccgatccctgtcctccccaccgtgcattataacatggacggcattcccaccagctacgaggggcaggtcctgaggcacgggaatggccaggatcagattgtgcccagcctgtacgcctgtggggaggccgcctgtgcctctgcacatggtgtcaaccgcctcggggcaaactcgctgttggacctggttgtctggtcaggcatgtgccctgagcatcgcagagtcgtgcaggcctggagataaagtccctccaattaaaccaaatgctggggaagaatctgtcacgaatgttgacaaattgagatttgctgatggaagaagcataagaacatcggaactgcgactcagcatgcagaagtcaacgcaaaatcatgctgccgtgttccgtgtgggaagcttgttgcaagaaggttgtgggaaaatcagcaagctctatggagaccggaagcatctgaagacgtttgaccggggaatggtctggaacacggacctggtggagaccctggagctgcagaacctgatgctatgtgcactgcaaaccgtcaatggagcagaggcggggaaggagtcacggggcgcgcacaccagggaagactacaaggtgcagattgatgagtatgatcactccaagcccatccaggggcaacagaagaagccctttgaggtgcactggaggaagcacaccctgtcctatgtggacgtcggcactgggaagtgcacagccagaggacaacacatcacacacaagaaacagttgtgctcatgtgatgggggcctcagcactaggaaggagtggactgttggcgcacgcagcagcttgaataaatctgaaagtcactacgctgcgtaagagaagccaaataaagcgcatgctgtgtacagagggtgtcgagaatgcctcctacgtgacggaaagcagatccgtggttccctgcagactggcaggagcagattccaaaggcacaggaagaagcttgcaggtagaatgtgttcattaccttctgcgcattataccacaaaaaagctgggaataaaaatgctaacc

SEQ ID NO: 1574 - DNA, 2116 bp, Homo sapiens
actcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgtgagtgtgaggggcgtggaggaggaggcgggctgggttgcgctcacacttaagcgtctgtgacaggagccggaatcgcattctcccttgaccatggttctagccaaagatctggctgaggagccctaagggtagaatggaggcggaggcatgagagcggagagtcacggagttccgaaaggtgtgagggagaaaggacttccaagaccagagaggggatttacgatatttagaaagcagggaaaggaaaataccccaagtatggagtccgttggaggtgttggtggatttatttgtaggaggaattttggcctgcatcacggtgggaggtcaagtggcatcatttggagagggtatggctacaagcgcttggaaagtcgggacactagacagagcgagaatttctggcaccctgggagagctttgagggggatgcgactgtggtgtggataagaatggctgatggacggattatcttgtgttcctcgttgtggggagcttccgctcttgggacatagccgctacttgtctgaggctccttctctcttgagttctttcagcattaggccttttagccaattgaggctgcttttctaaacatgtaggctgctggagaaaaagggataaggactgctacatcagaaaggagccagcgggaagacagtagaaattccactggtaaatggccatggctgtcttaacagatggggaagtgagtgctacagaggcccagtggtgtaagctgcttcccagttgctggcttagtcattggccaccctaataaaggataatttttagcattgccaaataaaatagatctgtcgttagagaataagaaaactgaaagatttttcaagatcataaaatcctgctccttatttccaaagtatatagacaaactcttgtaccttgagaatctaattgtagcatattaaaagggggctaccgggcccttccatttcattctcttcctgattgttgcacccctatgtttataagttttccagcagttatctttatgccacgaatcgtctaaattgccccagtaacttcacacacatttaatatctgtgtaatgtacagcaagtaatttaacaagtaattctgtaagcatcagttttctcatctgtgaagtatgaaaaattatacctattttctgggttgtgaagatgaatgaacataatctagggaaaacatttagcgcatatgccactgaattaaagagaagcagcttaaatttaaagacaagccttaagcaggaaagaagaatacagtataaatttattatcctaactttttgaataataagcaaatgaaagatagttcaactcagctaatggctgaggtgtttaacctttcatcccttcctaattttgtgagattccttgttctaatttaggaaaagaaatcaactgtcagtttttaattaggtcctgagagactggaaaggaaaatggcaggctaagtcagtctagaagaaggagtctcctatttctttttagtgagtcagctggtcaagttgtatgttgagcagtgggttaacttagggaaggtgggagttggaggtctgagttctttatttcacctcctattcagtcaactgtgtgaggaatcacttccccttcacttcttagt

SEQ ID NO: 1575 - DNA, 2032 bp, Homo sapiens
atggtcttcgtggagcctgagggtggcctccggggcatcctggattgccgagtggacagcgagccgctcgccagcctgactctccaccttggcagtcgactggtggcctccagtcagccccagggtgctcctgcagagccacacatccatgtcctggcttcccccaatgccctgagggtggacatcgaggcgctgaggcccagcgaccaaggggaatacatctgttctgcctcaaatgtcctgggctctgcctctacctccacctactttggggtcagagccctgcaccgcctgcatcagttccagcagctgctctgggtcctgggactgctggtgggcctcctgctcctgctgttgggcctgggggcctgctacacctggagctcattgatcctgatgcagccacatgtgagacctcaacctgtgccccacccctgggctgaccagtggtgttgcctgccctccggaggagaaagtggccagaatctgtgatgactccagcctatgaatgtgaatgaggcagtgttgagtcctgcccgcctctacgaaaacagctctgtgacatctgactttttatgacctggccccaagcctcttgcccccccaaaaatgggtggtgagaggtctgcccaggagggtgttgaccctggaggacactgaagagcactgagctgatctcgctctctcttctctggatctcctcccttctctccatttctccctcaaaggaagccctgccctttcacatccttctcctcgaaagtcaccctggactttggttggattgcagcatcctgcatcctcagaggctcaccaaggcattctgtattcaacagagtatcagtcagcctgctctaacaagagaccaaatacagtgacttcaacatgatagaattttatttttctctcccacgctagtctggctgttacgatggtttatgatgttggggctcaggatccttctatcttccttttctctatccctaaaatgatgcctttgattgtgaggctcaccatggccccgctttgtccacatgccctccagccagaagaaggaagagtggaggtagaagcacacccatgcccatggtggacgcaactcagaagctgcacaggacttttccactcacttcccattggctggagtattgtcacatggctactgcaagctacaagggagactgggaaatgtagtttttattttgagtccagaggacatttggaattggacttccaaaggactcccaactgtgagctcatccctgagacttttgacattgttgggaatgccaccagcaggccatgttttgtctcagtgcccatctactgagggccagggtgtgcccctggccattctggttgtgggcttcctggaagaggtgatcactctcacactaagactgaggaaataaaaaaggtttggtgttttcctagggagagagcatgccaggcagtggagttgcctaagcagacatccttgtgccagatttggcccctgaaagaagagatgccctcattcccaccaccaccccccctacccccagggactgggtactaccttactggcacttacaagagtggagggcagacacagatgttgtcagcatccttattcctgctccagatgcatctctgttcatgactgtgtgagctcctgtccttttcctggagaccctgtgtcgggctgttaaagagaatgagttaccaagaaggaatgacgtgcccctgcgaatcagggaccaacaggagagagctcttgagtgggctagtgactccccctgcagcctggtggagatggtgtgaggagcgaagagccctctgctctaggatttgggttgaaaaacagagagagaagtggggagttgccacaggagctaacacgctgggaggcagttgggggccgggtgaactttgtgtagccgaggccgcaccctccctcattccaggctcattcattttcatgctccattgccagactcttgctgggagcccgtccagaatgtcctcccaataaaactccatcctatgacgc

SEQ ID NO: 1576 - DNA, 2667 bp, Homo sapiens
ggtgcagactttccgagacctggtttggttgtgtcctcagtgtactgaagctgtatgtcaggccctgcccggctgtgaagagaacattcaagatagtgaggtagactgtaattctcctttacttctaggtagggggagaatgcttgaaaccctgccctttgaaatggaatctaattattctctctaccctgtgtttgaagtgggcactcttcgaattgattgccaccttagattctcttttggatatagatggcatataaattataaaaacaagatttatccgacgggttttattacaaaactctgataccattgttctcttgaacagttctgttttgttttgttttgctttgcttgagatagagttgcccaggctggagtgcagtggcgtgatctcggcccactgcaacctctacctcccaaactcaagtgattctcttgcctcagcctcctgagtagagtagctgtgattacaggtgtgcaccaccacgcccagctaatttttgtatttttagtagagagggttttgctatgttgtctaggctggtctagaattcctagcctcaagtgatcacccacctcagcatcccagagagctaggattacaggcataagccactgtgccccgcttctcttgaacagttttgagtcagagatttagaccatggagtttttagctagaatgaaaattataatcatttgtgaaatttttacaaagatttggacgtaatcacaggtctactgacttaaatattcaggggtgttggacctagacagataactttttttttttttttttttttgaaacagagtctagctctgttgcccaggctggagtgcagtaatgccatcttagctcactgcaacttccgcctcctggtttcaagcaattctcctgcctcaggctcccgagtagctggaactacaggtgtgcaccaccacgcctggctaatttttgtatttttaatagagacgggtttcaccatattggccaggctggtctcgaactcctgacctcaggtgatccaccctcctcggcctcccagagtgctgggattacagacgtaagccaccgtgcccggctgacagatacatttttaagaagcttcacagatgactctgatgtgcactctaggttagtaaccatttttgtgaaaaatttagagaaattctttgagcagcttccactgaaacactaaaacccaatagggccaaaggccccaaacctgaggaaaccttatttattgcttaatccaacataggctatgaaagttttgagtttcctcttgtgtattagaatttcattcctatttgttgtagagagtatagtacggggaatcagtaaattaaatgaagtaaactaaagattacaccttttctgctggcactaagcgaaaagcaaaaccagtggctgtctattatctcctgtgttttagacagtcaagtgttgagcacttgctcttattcctttattctctaggggaagcaagcacttatttggctacttggtgtccatggggaaagaattcctaatgctccttatgtgttagaggactttgttgagaatgtgaagtcggaaacatttccagctgttaagatggagctgctcactgcttcgctgcgccttttcctctcccgacctgctgagtgccaggacatgctaggacgtttgttgtattactgcatagaggaagaaaaagatatggctgtacgggaccgaggtctcttctattatcgcctcctcttagttggcattgatgaagttaagcggattctgtgtagccctaaatctgaccctactcttggacttttggaggatccggcagaaagacctgtgaatagctgggcctcagacttcaacacactggtgccagtgtatggcaaagcccactgggcaactatctctaaatgccagggggcagagcgttgtgacccagagcttcctaaaacttcatcctttgccgcatcaggtaaaaacagtccttaccttaaatcttgtcatgataaatctttaccttttcaatgattggtggaaagtagagtatcttagcactaaacctcagactgttgcctgaatttgaagcatttgtgagcaagaaagaggttcgtcactggttatttcagccatttgtccaaaaataaaagtcacattgtgtacatttgggaatttggataaaaaacttagctcctacagattaagaacatctttcacacaagttttctgtctcttttaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagag

SEQ ID NO: 1577 - DNA, 2248 bp, Homo sapiens
gtgagaaaccatgggatcctgatggagacccacaaagaactgaaaccccttctgagcccgtcttccgagaccacagtgaccgtggaactgccagaggcagacagagcaggcgcgggcaccggtgcccaggccggccaactgatgggcttctttaaggggattgaccaggatattgagcgtggagtgcagtcagaaatctttctacatgaaagttactgcatggacacctcccatcagccactgctcccggcacctccgaagacgcctatggatggtgcagattgtggcattcagtggtggaatgctgttttcatcatgctgctgattggtattgtcttgcctgtcttttatttggtctactttaaaatacaagctagtggtgagacccctaatagcttgaacacaactgtcatccccaatggctcgatggcaatgggtacagttccagggcaagcccccagactagcagttgcagtgccagccgtcacttctgcagacagccagttcagtcagaccacccaagcggggagctaagctttgtttttaaagactcggcccagctttagcaattggctgttgatgtgcctcagctgtcactggcgatgtcctaggggtgctgcattttgcttccggggaaggatggacacttttcagaagtcactgcagtattcccaattgcactggccctgggcatggccttacccagtctaagctggcaggatctaaaacagcagcgacctcggcccctatccagagaggtgcagcaagagagccatttccctgtgacatttagtggactggccagttcatagcagcactgtgaggacccccaagttggacgtgctcggagggaaagatttatggcctctgtcgagggacctgcagcgtgagagccagtggcatctgcgcggcttgcctggctcttgctgtatcctcacttcctgtggagcggggattggctctgagaaggagtgttctctgtctgcctggcaaaggtgctgtggaataggcttggcatgccaccctgttttagagagtgacagttacagttgtaacaagcctacttcatattggccccctcagttagcctttttgaggcaatgccatttctagagttgaaaaagccctggacccaaactgcggcgctgttgaataaagggcagtcctactcctgtccttttagagtggcttagtgtgacacacaggcatctcccaggccaagcacacacaggctgcgcccagttccgcaggagccgtcccacagcgtggctctctgggttctcccacttgtcctccttggaaggagctcttgctggccagtgtttggaggggaggatgagtgcctgtcactgaggcctcactatggttggcgtctgaagctgggcggtcgtcaggcctgtgctgagagccgcagcccctgtgcacacctaacacagggcgctccccctgctgcttccctggctcagttcttcggagctccagagtgagaaggccgcttcgtcctttttctctgggtgatgcccttagaataacactatatgcaatgtaactcacaatgttccaggaccaaagacttgatggaggggctagaggcgacccttgttgtaaaaggcgatcagaacacctgagggaggaaggggcttgcagttttcccagcccttctcgctgccaaggcagcagtggtgctgtggatgggctggggactgcgggacagagcctgctactacttgggagttggtgctgccctgtggcatggaggggtgggaggggctgagatggctgctggcctggcctccaagagttctggacaggaggcagacactgcccagatgctcggtggagggacagtgatggcctttgactcatgaggcctagagaaaagtatcaaaggtctcaccatgtaagagtgatttccgatttctctcctttcagttgtgtgaaaaaacagctggcctgggttccattagcaaattaaatcatcttcaatcttaaattagagaccagaatgatcttcaggataaaaagaacttctgaatctctgcaataggaaatgtttcgatcatgcaagtgctttcccagccaaatgtctgtgctctctgtgtcactgagggccacaggttcctccaacatctgtcactgtcacttcaccaggcaggccttggagttccatgacaaaatcacttttgtcagacaaagaatgtatcctttacttttctcaaatggaataaaattatttcttctgtggagg

SEQ ID NO: 1578 - DNA, 2256 bp, Homo sapiens
ttaaaaagcagctggggcctgaggtttctcccccagtaccctgggtcacctcagcccagagctggcggcaggcccccagcccctcatgtcagagccccctgtgtactgtaacctggtggaccttcgccgctgtcctcggtccccacccccaggccctgcatgccccctgctgcagaggctggatgcctgggagcagcacctggaccccaactctggacgctgcttctacataaattcactgactggctgcaagtcctggaagcccccgcgccgcagtcgcagcgagacgaaccctggctccatggaggggacacagaccctgaagaggaacaatgatgtcctgcaacctcaggcaaagggcttcagatctgacacagggaccccagaaccgcttgacccacagggttcactcagcctcagccaacacacctcgcagcttgaccctccagccttgcaggcccctcgacctctgccgcagctcctggacgacccccatgtgaacctcccatttctttgtgaaggccaagatcctccctgccccccctccccccttttcctgctccacataaacatcttcctctttctgaatatcctcctacccagccctcccccagcaactttaagggacttcactcctgggagaccccctagggaaagccgtggccactatggagggcgagggtgacttacagatcccattccctccacttcccaggaggtggaaaagtcgggtctgctcaacatgaccaagattgcccaaggggggcgcaagctcaggaagaactggggcccgtcttgggtggtgttaacgggtaacagcctggtgttctaccgagagccaccgccgacagcgccctcctcaggctggggaccagcgggtagccggcccgaaagtagcgtggacctgcgcggggcggccctggcgcacggccgccacctgtccagccgccgcaacgtcctgcacatccgcacgatccctggccacgagttcctgctgcagtcggaccacgagacagagctgcgagcctggcaccgcgcgctgcggactgtcatcgagcggttggttagatgggtggaggcccggagggaggctccgaccggccgggaccaagggagtggggatcgggagaaccccctggagctgcgtctgtcgggctctggacccgcggagctgagcgccggggaggacgaagaagaggagtcggagctggtgtccaagccgctgctgcgcctcagcagccgccggagctccattcgggggcccgaaggcaccgagcagaaccgcgtgcgcaacaaactaaagcggctcatcgcgaagagaccgcccttacaaagcctgcaggagcggggtctgctccgagaccaggtgttcggctgccagttggaatcactctgccagcgggaaggagacacggtgcccagctttttgcggccctgcattgctgctgtggataaaagaggtctagatgtggatggcatttatcgggtgagcgggaacttggcagtggtccagaagcttcgctttctggtggacagagagcgtgcggtcacctccgatgggaggtatgtgttcccagaacagccaggacaagaaggtcggttagatttggacagtactgagtgggatgacattcatgtggtcaccggagccctgaagctttttctccgggagctgccccagcctctggtgccaccactgctgctgccccatttccgtgctgcccttgcactctccgaatcagagcagtgcctctctcagatacaagaattaataggctcaatgccaaagcccaaccatgacactctacggtacctcctggagcatttatgcagggtgatagcacactcagataagaatcgcatgacaccccacaacctgggaattgtgtttggaccaaccctgtttcggccagagcaggagacatctgacccagcagcccatgctctctacccagggcagctggtccagctgatgctcaccaacttcaccagcctcttcccctgatgcagggaaggaagaagagaaaacatatttccggtcatctctggtggtgagaggttggtgttctgttttgaggatatccctttaaatctcccaaatgactgtctctatcttcatgagtgtgacttgaggtgttgggatgggtgagggagcttctctaaagaggaaagtgagtggattaacccctgcttctcttcttgttccctgttatcattcctccccaacataataatacataaagtggcatggtattt

SEQ ID NO: 1579 - DNA, 2185 bp, Homo sapiens
gtatagccatatgagtttgagaaatttttgttccgaactgtgtaaaccagaaaaagattagatgttaatacttggaagatttttaaaatctttttgttttggtctgtttttgtttataacagctgtaatgagatataattcacataccataaaatttatccttaaaagtatacaactcagtggtttttagtatagtcagagttttgcaactattactagtatctatttttatattgattgattgattgattgattttttgagacggagtctcactcttgtttcccaggctggagtgcatggtgcagtctcggctcaccgcaacctccgcctcccgggttcgggtgattctcctgcctcaccctcccgagtagctgggattgcaggcgtgtgccaccatgcctggctaattttgtatttttagtagagatggtgtttctccatgttggtcaggctggtctcaaactcccgacctcaggtgatccgcctgcctcagcctcccaaagtgctgagattgcaggcgtgagccactgcgcctggctactaatatctaattttataactccattactctgaaaagaaactccatactcattagtaattcctccctgtttctccctctctacaacctgtaatctattttctgtctctatggattggcctgttctggacatttcatataaatggaatcatatatgaccttttattgtctggcctatttcacttagcagactgttttcaaggctcatccatgttgtagcatgtatcagaacttcattacatctcaaggctgtatattccattttatggatagagacaacttacgtttatccattcatcacttggtagacatttggattgtttccactttttggctattattaataatgctgctgtgaacatttgaaagtttttcatgtggacatatgttttcacttctcttgtaaatatgcctaggagtggaattagcatagactctttagttgataaggcaaggaatgaaatgatgtgagaactaaaggttcttatttgggggatttgggatgttcccttctatgttagttctgtaagatggaaattctttgctctggacctcacagagcactgtacctccctgagatgcttaggacatcagagaaattaacagaaaagctagagcctccaatcagaaaagatcacaaacaacagaaatgcccccacataataaagagtgcttgtattaggatacagtagcaaaatcacccccacatcacagtggtttattctgaccaaagcatttattttcattccatttacataggaggtggcattgtagaaaataaaaactttctcaaagagatatgaattaaagaaaagttagagtaaggtgaatacttatttaacatacctttagagtgagggtaagcccccttcccaacccaaaatgaactgaatgagagagaaaaagaggtccagagtagtttgtggagcgatgtttccatctctaatgccactcagctcaggagcaggcttcagacactgcctttatctttacagaaagccatgggaagggaaatgtctgaggtagagctcagcgttgggcatcatatggctaatcactcagaggtcactaatcactctcccttttcttgtttttcagtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagc

SEQ ID NO: 1580 - DNA, 2104 bp, Homo sapiens
attttcttagctattctctattctagattatgttttgaattagcttttccagtttaatagaaaaatctttttgagatttttgatttggggagaattgacagttttacagagcccaggaaaatggtgtttctccttgtttgttaagctcttcctgttcttcagtgaagtctcacggctttcttcgtgtcgtctgggctcattcttagtcctggagtgcttggctctcgcgttcttacattccatagcagtctgcagattcctatgaacagaagagcctctgaatctcagattaggctgtgtttcgatctgacaggaaagctggttccctgataaaaagtccagaaatgcccgctcagctcagctactcctgaggtcaccagggccttctgtgcactccacgctgctgtttttgctcaggtttttgcctcgaggtttcacagtggctgccagagctctgaacatcactgacacattcatggcaggcaccaggaagcctccggagaagggacctttgctttccatggatctgttggctgatccgcagcagcaagagccatgtctcccagaagactgctccctctgtctcatgagccagcctggctgctctgctacaggacactccttgtttttatgtctctctgtgtattccagtgggatttggggaaggagaggcatcgggtgcagggactcagtgtgccttcttgaaaccagaaacctctcacgctctctgggcctgtttccacttctgttgatgtggtttttactccgttgtatgccgttgctctgtcttcacacgggcagccacacctctcctgttcgttgatgttcttgaggccttgttgcatccgctccttccttcttcagaggctcctttggatgagcccagctcctcagcagcagagtgctctttattttctgtttttttgaggcggagtcttgctctgttgcccaggctggagtgcagtggcgcaatctcggctcactgcaacctccgcctcccgggttcaggtgattcccctgcctcggcctcctgagtggctggggtcacaggcgcgcaccaccaccacgcccggagaatttttgtatttttagtagagacgttgttggccaggctggtcaccaggagcagagtgttctaaaagcatacctcagtctgatggatgacatcccagccatctgaagagtaacatccagatgtgttgtagcattccagtgtgttgtaacattcctgtagcattccaatgtgttgtaacattctggtgtgttgtaacattcctgtaacattctggtgtgttgtaacattccggtgtgttgtaacatttggtgttacgcggtgtgttgtaactttctggtgtgttgtaactttctggtgtgttgtaacattctggtgtgttgtaacaatcgcggtgtgttgtaacatccggtgtgttgtaacattccagtgtgttgtaacatttggtgttacatgctgtgttgtaacattctggtgtgttgtaacattcccggtgtgttgtaacgttccagggtgtgttgtaacatgccggtgtggtgttccggtctgttgtaacattccaacattccggtgtgttggtgtgttgtaacattccagtgtgttgtaacatttggtgtgttgtaacattccggtgtgttaacattccggtgtgttgtcacattctggtgtgttgtaacattctgatgtgatttcgggactcacctgggaggacttctcaggtgctaattggggacactaagttgcaggcaagactgtggagagtgagtgctatgtagtttccacctgatatttctggagataagaggaacagcggagaccaaacccatgacagacaagtttctactagcctgtctcctgtagactaaacacaaccccggcttctcagagcctctttgatttacctttgttttaacatcataaccttaaatttatgagtgaaagaaaataacacttcaagatgaaagcatctcagcactgggcacagtggctcacgcctgtaatcccagcactttgggaggctaaggtgggcagatcccttgagcccaggagttcaagaccagtttgggcaacatggtgaaaccgtatctttac

SEQ ID NO: 1581 - DNA, 2813 bp, Homo sapiens
gacagaattggccaaggtttcttggttggagggcggggggtgggaggtcaagtaggggccacctcggggaggcctgccctccaggtccttcccctaaaacttggcactgccgatactcccagcccgttccttcccaagtcaggaacttgcaggggaccccttggcaattctttttctctcaagagcagacagccttcagtcccagccgctgccagggctggtgtgtctgacccagctgtagtttttccaggcctgaaggccccggagtgcaccagcggcatgtacaaagagaccgtctactccgccttcaatctgctcatgcattacccacccccctcgggagcagggcagcacccccagccgcagcccccgctggtaagtggaccccgcagccagtgccgccctgtgcttgcagcctccttgaccagcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgcccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcagaacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctc

SEQ ID NO: 1582 - DNA, 2096 bp, Homo sapiens
aggtcaggtcaacaagtccttgactcctactacagactcttgaagttgtcttccttccagtctgtcactgccgccttagttctggctgtcttcatctctgtcttgaactgtaggcctctaaccagtctctgctttctctctcagccactgcttctcattcttcacgcggctcttggtgccatctttctaaatcacattaagaactttctcttccactgctaataatctttcaatgttgttttcattgcctgcagaaaaatgccagattcttggttgagatagtcaaggtccttcctgacttggaccctgtcatctctccagcgaaattctccagcacacccacagatgccacttttgtgccagacccgttgaactctttctagtttctaaaatcatcatcctgtcaggcctccagatctcatgcagaacatcccctctgtccttctccatattgtcttcccaacaaactggatgtttcctgtaagtcttaggttaaactttagaacttttgctggcaaattctcacttgctgcatatagaattggacacccttttttctgtgcccctctgttccccatacagacttctgttgtagcgcctacagcagcctgtggttttctgttgacgtgtttgtcttcttccttggaagcagggaccacacatcatcattcatctctgaatcccctgtacctagtgctgtctggccctgaggaggtgtttgctttatgtatttagaaagaaccatgcagatgagtagaaggttccatatgggcagaagtacctccggaggctttacttggtatcgtcactgtggggctgagtcttgcggcatgagttcttttgaagacaaccacttgccctaaggaagatcagcagcctctcaaatgcctgttatttctgggtccttgttaagccaaattttagaatagaattgttgatgtgaaaggaaactttactagaggtgaactgctagcctcttctcccacccaccttaatctacattttagggtaaacgagggggttagactttggttctcaatctcatggagacagtgtccctagtgtccagatatggggtggagtctggccttcccctccgcttcgtggcctggctggtgctacttggtatagggctgtggggctctcagctctttgctaaagtattgagaccctctccttgcttttctactttcccaagcactggtgaccccggcagccctgaggcctctggtcttgggtggtaatcagttggtgatcattgtgggaattgtctgtgccacaatcctgctgctccctgttctgatattgatcgtgaagaagacctgtggaaataagaggtacagggctacccccaccccttggattgggaggctgggggtgcaaggctgcctctaccccaaagtagaacagggtgatagggccctacttgtgccattctcacagaagggggtatttttaaatggaatcatctgtggtaaccctgcccactttgcttactgtgcccgggaaaagaatttaatattcctacgctctcctcattcactttgttattatgtaaagactacaaactcccttagaaatgggggcctcagtagggcataattcagagcataaatcttacacaagaactatcatggtaccattcactgcctaaaagatgatttttaaattatccatactgtacgttccgcatagaagctaagatcttaagggttgccagtggttttatctaaaagaccacattctaattatgagatacgatctttgaatgggtgccctcaggttctaaatgaattattattaaaagatgcttttggccaggcgcagtgtctcatgcctgtaatcccagcactttgagaggccaaggcgggcggatcacgaggtcaggagatcgagaccatccttgctaacacggtgaaaagctgtctttactaaaaatgcaaaaaattagctggacgtggtggcatgtgcttgtactcccagctacttgggaggctgaggcaggagaatggcgtgaacctgggaggtggagcttgcagtgagccgagatcacgccactgcactccagcctgggtgacagagcgagactctgtctc

SEQ ID NO: 1583 - DNA, 2325 bp, Homo sapiens
atgcccatcccaagatggcggagatccccctgtactttgtggacttgcaggatgacttagacgactatggatttgaagactatggtacagattgcgacaacatgagagtaacggccttcttggacattccaggccaggataacctgcctccactcactcgcctggagaagtatgctttcagcgagaacaccttcaaccggcagattattgccagagggctgcttgatatcttccgggacttcggtaacaatgaagaagacttcctcacggtaatggagattgtagtcagattgtcagaagatgcagataatctgcaaaatggcttcaatgctgagtaagagtaccgttgaacgcctgctactcccccgattctgtgaactgtgtggtgacaggaagctctttcaagttcggaaggtttgtgctgcaaattttggtgatatttgtcatgctgttggacaagaagccactgagaaatttttgatcccaaagttctttgagctctgctctgatgctgtttggggcatgcggaaagcctgtgcagaatgcttcacggctgtgtcgcacagctcctcccctggggtccgcagaacccagctcttcccgctcttcatcagacttgtcagcgacccctgccgatgggtgcaccaggctgccttccagtccctcggccccttcacttccacctttgcaaacccctccagggctggcctttatcttcgagaggatggcgccctgagcatctggccactcacccaggatttggactctggttttgcctctggctcccctgctcccagcagtggtggtaacacttcccctgccagtttaactcgttcagcaaagcctgtgcggagcgagccagagctacctgtggaagggacctcagcgaaaaccagtgattgcccacacagcagtagctcctctgacggcccagcggaaagccctgtggaaagctgtgtgtcggctggagctgagtggaccagggtttccccagagaccagcgcctgctcaaagctttctgacatgaatgacctccccatcagcagctaccctggatcagattcctgggcctgcccagggaacactgaggatgtgttcagtcattttctttattggtgaactcctctccctgacataagcaaggacttagagctgcttctgagtgaggctgggcctcaggaggacgactgcagcagacctggggttgtgcacaacagctgtgtggcccggagtgagattcagaaagtccttggtagcttgcaggagcatctgatgaatgatccagatgttcaagctcaagttcaggtattatccgctgcactgagagctgcacagctcgactgcgtgaatgaagctgagagcaagccaacagcaggcctaaaggaagtgtccatttcacatcccagctctgcctctgacaatcagatcgctctggcggcctcatcatctcaggatgagctctttgtggccaggatattacaaagcccagatccaggtggacccagaaatggaaccagtgaccatctggagactgaccagaggcaggatcccaccccacttgaagagaataaatctaaattacaggatgtaataactcagccgctgctagatcagtatgtgtccatgactgacccagctcgagcccagactgtcgatactgacatagccaaacactgtgcctacagcctcccaggggtggcactgaccctgggcaggcaaaattggcactgcctgaaagatacatatgaaacactggcttctgatgtacagtggaaggtacggcgagccctagccttctccattcacgagctggctgtgattcttggggatcagttaacagcagctgacctggtgcctatcttcaatggatttttaaaggatctggatgaagtgcgaataggagttcttagacacctgtatgattttctaaagttgcttcatgaagacaagaggagagactatctttatcagcttcaagaatttgtagtgactgataacagcaggaattggaggtttcgatatgaactagcagagtaagtaaaaacatatttggggatatgagaaagcaaactagatggaataaatcttaattttcttaccatataattgatttctaaagcagcagcaatagtgttcttttagataaagagattatgtttttattaaggtataaacagaattccaaaaaccctgagttacaaataccacagtctccggggagacattcattttcagatgaagacagggcttgagtcactttcgaattagagtgttctgctgttctagaaggcaatttatttgaaccaaataaaagatgaatcaccc

SEQ ID NO: 1584 - DNA, 2057 bp, Homo sapiens
actccttgcagctgaagctgcagctgggcagaagggggctgagctgacactgcaaacccgcatgggtgggctttgggctccaagcaggggcctttgcctggggatcactccccaaccaccacctggtctcccagccctgcgggcagaatgggctccagggtagctctcagaacaacagagccctctcctctcccctctgcagatggaacccccggaatctgctcctagtagaggccagtctgggcctgacctggcattccaccctgcagatagcgaggaggcaccccaagcacggagaagacccaccaagctgcctgatatctctgtctacctcccctctgcccagacaggaactgctgttcaccattcattccagacctgggcctttgaggacaggagctgtaaggatgattgatcgattgcctgtgtgtgaagccctggaagggctcttgcctagaatactgtccctaccctgacaaggtagaggccatggtctggatggcggtggcccccccattcatatgtcaaaacctaaccctcaatgcaaggtggggcctgcaggtgaccaggtcctgaagcagagacctcatgaacgcgatgagtgcccttacacaaaagcctggagggagcccgtcttccaccatgagatgacacacagaaggcaccatctgtgaggaatgggcctcaaccagacactgattctgctggaggcttgatgctggacttcccagcctccacagctgtgaacaatacatttccgtggttttataaatgaccctgtctaaggcgttctgttacagcagcacaaaggaactaagacagtgggcacccgtatttccatttagaggcggaaactgactctgaagtgagaaccggtccactctgagagcacatcgccaggggaagaggactgtagccaggaagttgttatgtcatggggtcatgggaggacccagcaatgttgtttctgatgatttctgaaaggcggctcttttctggaagtggacagatgatgggggaggggcaggaagctgaattcaccacagtgtccgagaacactgtctaccagcgggagctgttcagacacacctctggccagtccccacggcagtgaatctcctgtctctggacaacagtccaacagggaaagtggggaggagggttgggaactgaactctgttccacaagttcaaccactgcactccactaagcaactggcacagccagtccctggtgaaggcttaaagatgaggaagatggggtcagcgcctgccctcctggcctcaacacatcaggatggaggatttaggtgttagcaaaaagtggctcaaagttccaatgaaggacagggagcaaagggagacttcttttagaaaggagacgttggaacttggatatggctttagttaaggagctccaggcatctcaagtcagccctgagaggcagcagccgtgtctgcctctcagacagctatgccccagcctccagctcatcagctggcaggcagcaggtgtgggtgcaggaatgagtgaactcatggggaccagcctcagcaaagacgcacagtccccacagtgccccaggggctgggaaacagtgagcagccaccagcaagaccaaggcagtgcaagtggccacagctcaaggtttcccccaaggaggactatgtcacttaaggagtatggcctctgaagtaatgtaaatatggcctggaagattcagtcaacacctatttccttagtgcctacaatgtgcaggtgcagtttctgctcccggagttcagtcatgaacgatgccacagtcagccctgccaacccacctgcgtcagctcaggcacccagaacaatgtcacctggatctgccctccctcccatgtcactggactcgctgtcttttccctgcaatgaaacctccaactgctttccctgccactgtgggtggaagggccctcttcctcttcccaccttcatacagcttccaggccacctccttaagaatccaaagcaatctggtcacaccacttggtgggaaatacaccgaaatgttaactgtcctt

SEQ ID NO: 1585 - DNA, 2273 bp, Homo sapiens
ctttctgtttaaaattttgcctggatttctgattatttttctcaagacaggtatatatttaaatttattgaggttaaaaggtatgccttcagactcttgttgaaattgccaaatcattttgagaactgtttgtaccagtttttacttccatctgtacttatgagaatgccagacagaagtattattttttaaaaagctaatgtggctgggtgtggtggctcatgcctgtaatcccagcactgtggcaggcgcctatagtcccagccacatcctatgctgtggcatgggaacccaggctgaggcatgagaattgcttgaaccctggatgggggatgttgcagtcagccaagatggcgccactgcactccagcctgggtgacagagcgagatgctgtctcaaaaaaaaaacaaaaaacaaaaaacaaaagctatatgttaagtgaagcatagtatgttgttttaattagttttttgttttttttttcctcctgagacggagtctcgctctgtcgcccaggctggagctcagtgacgcggtttcggctcactgcagcctctgcctcccgggttcaagcaattctcctgcctcggcctcctgagtagctgggattacaggtgtgcaccaccacgcctggctagtttttgtatttttagtagagaaggggtttcatcatgttggccaggctggtctcaaactcctgatcttgtgatccaccctcctcagccacccaaagtgctgggattacaggtgtgagccaccacacctggccattttagttactattcttatattactagtaagttgaacatttttacatatgcttatcaagtttggctttaatttttatgtaacccaaattgttcattttgttttaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaattttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaagataaatctttctgacatgcggacggaaatcaagctgaggcctccttatcaaatttccatgtgcgaactggggtcagccaatggagtcacatcagcattttctgttgactgtaaaggtgctggtaagatttcttctgctcaccagcgactggaaccagcaactctgtcagggattgtaggatttatccttagtcttttatgtggagctctgaatttaattcgaggctttcatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagagtcctctcagaagaatgttggccatgagactatcattcagaggaggaggggatttctctcttcaaggccataacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaatttc

SEQ ID NO: 1586 - DNA, 2397 bp, Homo sapiens
tttttagttctgacttaggccaaaatagaaaaaaagaaagtatgttcagaaggcaaatggtcatgagatcaaaggccaagggaccccgacagggcaggcgcagagctcctgcttggggcttgggtggggtgtttgtgggggttattctgctccgccccccggaaaggccaggagcccttcggattggcgtcttgctgagctcctgctgccccctgctggtttcgcggcactccctggtcctcagaaatgtagacaggatggtcaaatggaatcccatctcccctctctctcttcattcacttaaaattacctctcccatacggactgaaagtggcttgagtgataatagagaagttgaagctgcttttcagcctaaattatctccagaacggcttcttgttcttcattagaagagatgcgcttctcaggtttccaggtgagccggatagccctggctgtaggagtccagagagaatagttccttctctggtgtctctctcttcacgaagccaagaggggatctcatgtagggacccttgaataaaccatgcccgctggttaattccacatgcttttcatgtcttgcagttcagtgaattctacagtcttggtgaagaacacgaagaagactaatccagagataaaagaaaaaccctgccattttgaaagatgtgaaggggaggtgaacacacgcttcagcctaaaacactaagtagatgcaggcctgggccgttctcatacccccgggaaccatatcttacccattgtatgtcgcagcttgcaggccagtgcttggcacagagcagggactcaggaagcctttgtcactaaagtaagagcctctgcggagtacagtgcatggggtcggctgggccagccccaggcagcagatcctggtattgggctgaggaaagagcactgcgcttggagtcagtaagatctgccacctccctgagtctcatcagcaaaatgaggataaagataaagatactatagttgcccagcctgcttgacagggttgttgtaaggttcacataagatgatgatatgcaaatgctttgtaatctaggaggtgctatttgtctaaagtctaatggagaattataatacatccaggagttaaggagttctaatgcttaaaatgaaatagtctaagatcttagcaagaaaggattaagaaggacttttctctccatattgattttgtaatggagttataaataattgcttctagagactgagaaattgattggttttctttaactcctattctttcttttctttctttaatttttaaaaaactctttgaatagttacctttctctattttgggctgtttttgtcccaagagtaggattttttcccagtagagtgcagtggtccaagaatgggccactggatgatactgctttaccaacgagtgacaggaccatgaacctcacagttgtgaggttcaatgagggctggccctgccacataaatcctctgagggagatgatgacaattcactgctgattaatgccattctgcctttactgtaattagaaggaaataaccccagaatacaaggaatttagcaagataaggaacccctgctgctacctaaacatccatctaaacaaagatgtttggcttttgaagcaaagagtttggttctcaagactgtgttctttgacagttaattttcaagaagactgaagactgaattatcattgttgagaattctctaggtctcagtaaccctctgaaccagcagtttgggtggtcgatgcccagcaaataggagtgggtggccttttctctggtgtataagattcatctaatttttaggaatttttgtaccattttccccctctagaaacacatttactccccaataattgtacgggaggtgatcgaggaagaagaaccaagtgaaaaatcagaggccacctacatgaccatgcacccagtttggccttctctgaggtcagatcggaacaactcacttgaaaaaaagtcaggtgggggaatgccaaaaacacagcaagccttttgagaagaatggagagtcccttcatctcagcagcggtggagactctctcctgtgtgtgtcctgggccactctaccagtgatttcagactcccgctctcccagctgtcctcctgtctcattgtttggtcaatacactgaagatggagaatttggagcctggcagagagactggacagctctggaggaacgggcctgctgaggggaggggagcatggacttggcctctggagtgggacactggccctgggaaccaggctgagctgagtggcctcaaaccccccgttggatcagaccctcctgtgggcagggttcttagtggatgagttactgggaagaatcagagataaaaaccaacccaaatc

SEQ ID NO: 1587 - DNA, 2952 bp, Homo sapiens
catgaagaaaaaaaaaattcaaaagatctacgaattcagggtaggtttcttgaaaatattaataagaaagtctgctagcagactaatacagaggatgattgaaataaacacaattagaaatgacaaagggaatgtaattaccactgaccccacagaaatagaaacaaccatcagaaactactgcaaacacttctgtgcatacaaactagaaaacttcaaagagatggataaattcctggacaaatacaccctcccacaactgagccaggaagaaattgatttgctgaacagaccaataacaagctccgaaattgaatcagtaataaataacctaccaatcaaaaaaagcccagaacatgatggattcccagccatattctactagaagtacaaagaagagctggtaccatttttacaggaactatttgaaaatattgaggaggaggaactcctccccaactcattctatgaggccaacatcatcttgataccaaaatctggcacacacacacacacacacacacacacacacacacacacacacacaaacttcaggccaatacccttgatgaacatcaatgcaaaaatcctcaacaaaatacgggcaaaccaaatccagcagcacatcaaaaagttaatccatcatgatcaagtatgcttcatccccaggatgcaaggttgcctcaacatacacgtcaattaatctgactcatcccataaacaaaactaaagataaaaaccatgtgattatctcaatatatgcagaaaaggctttcaataaaattcaaggcctctccatattaaaaactctaaaaaatctgggtattgaggaaacatagctcaaagtgatgagctgtttttgtaccagtatcatgctgttttggttgctgtagccctgtagtatagtttgaagttgggtaacatgatgcctccagctttgttctttttgctgaggattgcttggctattagggctctttttttttttggttccatatgaattttgaaatagtttgctctagttctgtgaggaatgccattggtaatttaatagggatgacttgcatctgtaaattactttgggcagtatggccattttaatgatgttgattcttcctatccatgagcatgaaatgtttttccatttgtttgtgtcttctctgatttctttgagcagtgttttgtaattctcctagagatctcttagagatctttcacctccctggttagctgtattcctaggtattttattttttctgtgtgtagcaattatgaatgggattatgttcttcatttgactctctgctttactgctaggaatttttgcacattgattttgtatgctaagactttgctaaagtttatcagcagaaggagctttggggctgagactatggggttttctagatatagaatcatgtcatctgtaaacagagacagtttgatttcctgtctattcctctcttccctcctctatttggatgcccttccagttttgcacattcagtgtaatgttggctgtgggtttgccatggctagctctcatcattttggcacttccgactagaagtgcgagaggggccagtgttgttgttacctgaaaggtaagtgcagcccacaaaaatgcagtgaagaagaagatatatgcatatgtttaagttaatacaattgagatacatttagcagacagaatcaatagagttgatgagtgactgactggatgtgtggggagtttatatcactcccaggtttttgacttgggcaaccgggcactcaagaaggaaaaagaggatccagggagaggaacttttctgaggactggggtagggctgaacagctgcattcgagactggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgtgaggacactgaagaaggagtgagcagacaataagaagcccacagaagacagagaaggaacaactagagggagaagccaaggcaggcatgtgtgataacatataggaactgagggagaggacatttcaagatggaggggatgccatacaacaggactatgtgatggtttttggctgtgtccataggaagtcacaacaggcaagggaaagaaaccagaacccagtcatggagttaagaagtgagtcagagaggagatgggtagggacagtgaggtaaggcctctttctaaggaagtttggctgaaggatagactagctggacatatgctggctgtgtggggtagagggaggaatgatggagggtgggagagccttgagcctgcgagaagagtctcctagaatagagaagctgaggttaaagttgtggaagacagtggggataactgagtgacagataatcaggagaagaaaaggagatccagaatcatgacagagagatgacctttgccaagagcacagccatctttcactgtcacagagaggtaggacaaaacgattggtgttcaagaattggtttgtagcacaatattttaactatgtcctttaaaaagtttctccacagacactacccaaagcagtccttcactacagtggcagacagacctgaaaattttcatctgaagcagcagagtgaactgcagagtcagagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaagacaaaatttattgaatatactttttcaaacaaagtttcatgttctaatcattgtctgatttcagcattaaatgaaacacagt

SEQ ID NO: 1588 - DNA, 1800 bp, Homo sapiens
ttttcattgtcccatccagagtaatgctaggtcctgggaggctgtgagagttcgggaagctggcatcaggttcccgatgccaccatttggcttcagcgctcccaccatttggctttagctcatgctactagttcatgttatgctgtatttccttaatctatgctatagccaccccaaacagaatcagagctaagggagctaaactctgaggggagcagtcagcaggttcacttgcaatatctaaagtgccaggaggaacttggactttataggtagtagtatatagggagagagtaggaagcccagtgctgtggttaatatgggccaaattagatgaagattaagtagctgggttatttgcagatgttattaccataattaataataattatattcccttttgtgctctgggcctcactttcttatattcagatagctgtagacaacccttaagtgttctgcctctagtttctcccggaaagcccatgttgtacatgctgccagtgatcttcctaacctacatttgggttctgtgtctcctgcatgatttccttttcctgtttcctttaacttcctgtacctaccactccatctctttaaatccgattttagcctttcttttctttgtttttcattgaaatatatttttaaaagagtcagggtcttgctctgtcctctaggctggagtgcagtggcacaattatggctcactgtagccttgggctcctggactcgggtgatccttctgcctcagcctcccaagtaggtaggactgcaggtgtgcaccaccacactaggctaactatttttgtagagacagggtcttgctatgttgccaagtctggtattgaactcctggtctcaagcaacccctcacctcagcctcccaagttgccggggattacaggtgagagccactgcaccttggctacctttgttaattctctggacatacctcctaccgcttcggtctggctccaatcttctttgtcttataaacattttatgtttatttccagtcccctttctttgctcaggtagttctccttacctggaattaacctcttgtgcccctccctgcacccctagccctgtctgtatcaatcttagttgtcctctagaatgtgccagcttcattttatatgaaccttccctgactttcccattcctactgatcttcctcatctcaatactaactcccatagtacatagtctctatcgctcgatttagcacttaattagaaattgccttgctttgtgccctaatgattttgattgtattgttttgtctataactttgtgttcctgcactaatactggcattattaaagcacaactcatcagattacttctaccatgtgccaagccaagctgattacatataaagttttgtttaatccttaaccactctgtgaactaggtgttattaactccattttagagatgataaaactataaatgagtggcttacttttgcttgtttaattaatctaaactctgctctgtcattcaatgctcccaccatttggctttagctcatgctgctagttcatgttatactgtatttccttactctatgctatagccaccccagacatgctcttcatatcttatcactgtgcccctgttccagataaatccttatcctggcatttctctgcttcccactttgcctgtaaaaatcaagccgggtttggtggttcatgcctatgatctcagctacttggttgagacaggaggatcgcttgaggccaggagttctagaccaggctgggcaacataacaggaccccatctcttt

SEQ ID NO: 1589 - DNA, 1945 bp, Homo sapiens
agaacgcacggctcaactcatgtaattactgtttatagctggccgagcctgactaggagagggcagacccgagaggaaatcagtttcccggacctttgagaggaggctgtgtgttaattaaaggctaggacgggacgggtacttctcagacatgctccaagttgttcttgagatcacagttcccatcacattttctctggagggagtgagtagataattgggattttttttttttttatttttggccttgtctttcttccttttttttacctctccccattttagtcatatggccttgaacccacagtgaattgaagagagaaagaaatggatatgtctgaccccaatttttggactgtgctctcaaactttactttgcctcatttgaggagtgggaacaggcttcggcgaacacaaagttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactatattgtgaagctgtaaaaatatatatatatactttacaagagtttactaatggatttcaaaactggtctcaacgtttataatacatatctgtgtttggcagttgtcataacttaaccgactgctcagttgtccttcgttgtaaaatgaattggctttgggaaaaaggaaaaaaacaaac

SEQ ID NO: 1590 - DNA, 1471 bp, Homo sapiens
agggcggcctggccactgagccggggtgcagtggcagcgggagagtacctggctatggcgatatgagcggtgcgggggtggcggctgggacgcggccccccagctcgccgaccccgggctctcggcgccggcgccagcgcccctctgtgggcgtccagtccttgaggccgcagagcccgcagctcaggcagagcgacccgcagaaacggaacctggacctggagaagagcctacagttcctgcagcagcagcactcggagatgctggccaagctccatgaggagatcgagcatctgaagcgggaaaacaaggatctccgttacaagctcataatgaatcagacatcacagaagaaagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcatgggcgtcttgcgggcggtagcgccgacactgtgcgctctcctgcagacagcctctccacgtcaagcttccagtctgtcaagtccatctctaattcaggcaaggccaggccccagcccggctccttcaacaagcaagattcaaaagctgacgtcccccagaaggcggacctggaagaggagcccctacttcacaacagcaagctggacaaggttcctggggtacaagggcaggccagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgacacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttcc

SEQ ID NO: 1591 - DNA, 1672 bp, Homo sapiens
taggctgtgatggaatctgaaatgaagtttgacaaggaccatgatggactcattgaaaatggaggctatgcagaccagacctatgatggatgggtgaccacaggccccaggttagcgggtaggggtttccaggaggcctgaggtgagaaactgggcaacaagggattgtagggctcaagaaagaatgactcattgtctattacacggcatgggagcagctggagctgccagtctgacccccaaacccatgtccctgatcagtgcttactgtggagggctgtggctggcagctgtggctgtgatggtccagatggctgctctgtgtggggcacaggacatccaggataagttttcttctatcctcagccggggccaagaagcctatgagagactgctgtggaatggtgagttcggggagcctaagtagtcttaaggcagctgagaggacaccaggagccttatttttctcttcctcgactccaggccgctattacaactatgacagcagctctcggcctcagtctcgtagtgttatgtctgaccagtgtgctggacagtggttcctgaaggcctgtggcctaggagaaggagacactgaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagaggtaatgcactccttttcccatctctccaccatctgtatcctggcccagaaaacttcctcaaccaccaaatttcttcaaggcataacccaatgccatcttgtccgtctataaagcctcccatttttccctggtatgcattccagctcctgccttcaggcttctgtctgtgggtcatagttatctcctccacttgctgggagctccttgaaggcaaagactctactgcctccatctatccagtggaagtggctcttcagagggtgccaagttagtatgtatgactgtcatctctcccaacagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttcagggaggtcagttgatttccccaggtacattcatggtgtgacagacacatgggtacaaataaaagacccagaaagcc

SEQ ID NO: 1592 - DNA, 1766 bp, Homo sapiens
tataattagaggttttcctgttgtgtaaaggaaaggaattcctttcctttcctgtgtgtacaagacttctgttctcaataaatgtgcttccctgtcccatttctctttctgcaggtaatagagggaaagctggctccattcttgggcaaggtcattaaatttgccacctcacacgtgtacagctgcagtctttgtagccagaaggggttcatctgtgaaatctgtaacaatggagagatcctctacccttttgaggatatttcaacaagcaggtacagaatatcttatttcataaaagaacacccaaatgtgtaatatgccattttctttggccaaatcaggccaacttttagtcaagtagtgtatctctgtctcttaccctggatcaggttttccttgttcttggagaacatgtttccccctttggtttcctgtatttatttccaccccttacctcgctacctttatccagaatgagataacagagctgcaaagaaacattgcctaactctgccttattaggtaacagagagtgttcaggttcaattttagaatgaagactggggaggaagcatcttaataattttttcagagccaaatgataggcaatgggaaactgcagtctcagaggaaggcccaaactggaccgaccgccaggggtaaaactagaggacactggtgagcagctgctgcctggccatgtgcttttctccgcagatgcatgcactgcagtggagcgatgaaagttttaggatccaaaggagagaaaaatgggagtttatgtgggatgatttttctaaccaaagtaatatttgggcatcatcacatccatggattgatggatgattcacaaaatgatacatattacttttcctttcatcccaaaagcgtaatagaaatctacacggtatgtgtgtgcactggcctctttgggcatgaatgtcatggctcatttcccaccctgcagggctcacttatactgtggttcagaacagaaggtaaggcatacagccagggagagttgaagcatgtagggtagagctaagatattgagagttgactcagcccttttagcctctcctaaaacctaaagactatttgtaaacatgcgggaatttgggttggcccacacacagaaaaacagacacataaacacatagacatgcagatacacacacacacacacacacacacacacacacacacacacacacacacacacacacacacagaggcagagttcagcctccagtttcctgagcaggtacttagcttatagagcttatatagcccagagattagctacctcttaaagggaggaaactcctcacagcctttttatggccaagtgagaggcagtgggaaattgcagtctcagaggaaggcccaaactggacgaaccactggtagtaaaattagaagacactgctgaacagtaacttagcccatagcctagagattagttacctctaaaaaatgtacaccaggctgggtgcggtggctcacgcctgtaatcccagcactttgggaggccgaggcaggtggatcactgaggtcaggggttcaagaccggcctggccaacatggtgaaaccccgtctctgctggggatacaaaaattagccgggcatggtagcaggcacctgtaaccccagctactcgggaggttgaggcgggggagtcgcttgaacccgggcggtggaggctatagtaagctgagattgcgccactgcactccagcctgggcgacacagcaagactctgtct

SEQ ID NO: 1593 - DNA, 1811 bp, Homo sapiens
ctccgggacggtgtgccaggccggggccaagtcggaggcccctcgctctgggtgggcgctggggcccgcgagggctactgtaaggacccctggcttctgaggatactgcgtctagaactttctccgtatggggccttgaggtgcttggtcgagacctgcctttgcgcttggtcccgaatcctgccctctaggagtcgctcttgcgggcctccagcccaccggaggcgaagcggccccgggcggaaggccgctggatcctcgagggaggtgccggtttctctccgcgggcgccgtggggacggtgggaggcgggggcgtcggcagcgcttggactaggtgcggccttgggcctgcctggtagcggggatttgggcccgcagagcgcccgcctctgcggctgagttctgcctggcggggaagggagcgcccgatgggtgccgaggcgtcctcctcttggtgccctggcactgctcttcccgaagaacgcctttcagttaaacgggcgtcggaaatctcgggcttcctggggcagggatcgtcgggagaggccgctctggacgtgttgacacacgtgctggagggggcaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgt

SEQ ID NO: 1594 - DNA, 1764 bp, Homo sapiens
agctctgggagaggagcccagcactggaagtcgccggtgtctccattcggtgatcagcactgaacacagaggactcgccatggagtttgggctgagctggattttcttcgttggtcttttaagaggtgtccagtgtcgggtgcagctggtggagtctggggggggcgtggtccagcctggggggtccctgagactctcctgtgcagcctctggcttccccttcattaattaccctatgcactgggtccgccagactccgggcaagggactcgagtgggtggcacttatttcgagtgatgggagtcgccaattctacgcaggctccgtgaggggccgattcaccatctccagagacaattccaagaatagactgtctctcctacttaaccgcctgagagaagacgacacggctgtctatttttgtgcaagaagcgatcaggccagaccacaatataatatttggggttcttccacttctgacttctggggccaggggaccctggtcaccgtctcctcagcacccaccaaggctccggatgtgttccccatcatatcagggtgcagacacccaaaggataacagccctgtggtcctggcatgcttgataactgggtaccacccaacgtccgtgactgtcacctggtacatggggacacagagccagccccagagaaccttccctgagatacaaagacgggacagctactacatgacaagcagccagctctccacccccctccagcagtggcgccaaggcgagtacaaatgcgtggtccagcacaccgccagcaagagtaagaaggagatcttccgctggccagagtctccaaaggcacaggcctcctcagtgcccactgcacaaccccaagcagagggcagcctcgccaaggcaaccacagccccagccaccacccgtaacacaggaagaggaggagaagagaagaagaaggagaaggagaaagaggaacaagaagagagagagacaaagacaccagagtgtccgagccacacccagcctcttggcgtctacctgctaacccctgcagtgcaggacctgtggctccgggacaaagccaccttcacctgcttcgtggtgggcagtgacctgaaggatgctcacctgacctgggaggtggctgggaaggtccccacagggggcgtggaggaagggctgctggagcggcacagcaacggctcccagagccagcacagccgtctgaccctgcccaggtccttgtggaacgcggggacctccgtcacctgcacactgaaccatcccagcctcccaccccagaggttgatggcgctgagagaacccgctgcgcaggcacccgtcaagctttccctgaacctgctggcctcgtctgaccctcccgaggcggcctcgtggctcctgtgtgaggtgtctggcttctcgccccccaacatcctcctgatgtggctggaggaccagcgtgaggtgaacacttctgggtttgcccccgcacgcccccctccacagcccaggagcaccacgttctgggcctggagtgtgctgcgtgtcccagccccgcccagccctcagccagccacctacacgtgtgtggtcagccacgaggactcccggactctgctcaacgccagccggagcctagaagtcagctatgtaacagaccatggccccatgaaatgatcccggaccagatccgtccacacccgccactcagcagctctggccgagctcacagtacaaccacaataaactcttgttgaatgaactctagg

SEQ ID NO: 1595 - DNA, 1974 bp, Homo sapiens
aagagaaacaataggacggaagcgtcgcgggactgggctgtggccgcagagtgtcctggcctgcacaaaccgaggagctgagatcaaacaggtggctgtaaggacagacagtgaacggagggcaagccggcctctggaccccgctgcctcccctttctccctgctgctcgtgtccagaggatgagcccagccttcaggaccatggacgtggagccccgcaccaagggcatcctgctggagccatttgtccaccaggttggggggcactcatgcgttctccgattcaatgagacaaccctgtgcaagcccctggttccgagggagcatcagttctacgagaccctcccagctgagatgcgcagattcactccccagtacaaaggtgagcccccagctgctagaggggtctccaggctggtgagatgtaagggattttgccagtggaaggccctggcagcgtcctgggagccctcccccctcccatttacccttttgttttcctcctcctcctcctcttggccctcagcccagcacctcaccctcagttttcaagccctggtaagattgctcaattgttttgttttctggatttgctttgagtttgtttttggtagaagtatagttatttttttatgttcaggtgtctcttgctcaaggtaacccatagtccccatgtggggacagttcgggaagactttaggaggattatgcacagaattcttgctgcctgctttttgtcctccaggaaaccagaagccctggtgattaggtaggctgggagcagggttgagtcagatggaatgcaggagtgggaggattgtacagtcaactccagccctttgctgttacagaatgtccccagaattgctatgtgaaggcaacactttgattcacatgtagtgactttttctctttttataattatatgctttgagggaaccagccaccagcatggtgcgctttttcctggggaggggaggagtctttgtaaatcagaagagaactcgttaaattaatttgaaatgtgcattaccagggataaagaagactaggacaacatagattcccctgggacacaattgttctttaaagacagggtggactgggttacggctctctacttggaaatgcatgtggtgggactgggggtgttggagaccctcacttggtccttttctgttattttttccaggacaaagccaaagttcccttgttagctggccacccctgccccgtttttatccctttggtcgttccttatgcccacagggaagtgtggtcccctgacaccccccctcccgctcctctgcgcccagagctggggccgcctcagaagtgtcgtctctctctgagcacgcattcccctgcagcacgcaagcgggcgggcagcaaggactgagcagattgagtgaccgtggggcagagaggcctaggaggaaaggtgttgagccagtcggctgtaaggcgctcgtcggcaccgctgaagtgctcccacctcacagccccttctcaaagactgtccagttacacatggcaggtcctagagactcaaaagggagagctgctttcaaggctaccatgtgcttgtgttcctgccccctcatctgctggtgttcattttgttcttttgtgacacaaactacaaaaaccaataaatgcataactgagaaggacaaaaggcttggctcacccaccatgcaggcttgtggaagcctttgccagggcgtctgtgctgtgtggattgtttgctgctttcttttgctttgcttgcccagtcttccctcaccctcagtgccttcacctgagggcacacccgtgttccctgcagtcaggctctgctttaaagcaagcctcaaggccgtcggagtttctgtttagggcataaacactttcataagctatatagagcaatgtttttgtgtctttcttgggattagaagagttacataaaattaataaacattttcaatgatg

SEQ ID NO: 1596 - DNA, 1920 bp, Homo sapiens
atcagggcggacgtgacgccttagcgtggtcctcagacctcgctgtgcccggggtggggcgtgtcggctgctaccgagaacctgctcgggggacgcgtccgtcaaccggaatccaggggacagaagcttccgacgcgcgaggcctcgggaggagcgtctccttggtaactctcctccggtcgcaagacctggaagtggcctcagggggtcgcccttcctgtccgtcgtggatgaaggggaccacttggcttcagaaatccccgctggcctccgcctcccctggggtttccctttcggcgcaggcggggcagcggcgtcatcacaaccatcgccaccccagtaatcacagcgagcggccctttgcgcacgcgtggagccttctcaggcctcagtacttctcacttcgcccggcaaggctggccaggaggggtgcattctccctttccgcgtatttcaagaccactccccttctgcatgctcggtgtcccagtctgtctcctcgctgcctcccgaggcctggaactgaagcaaagttcgccccaagccgaccgttctttgaagttgaaatcctcaaaaagcctgcagactgaatagcgctgtactgggcacgcgcattgcgcttccagccgcccttgggtgctgcgtgctgggccgggtcgggttggggccttcctacatactcttgcgaccattaggctcttcttgggtgagttgcaagttaaaattaccagggctctctgaacatggaccttggtgctttttttctctctccctcttccgtgttctttttcaaacgcatcttctcccttattagattcagagaagccagacagggcaggcaggggtcctcagatgtgcagtctgcagggcctgaggttgtacaccagggcagtggaaaagcagctaggacttggactttcacagttacatcgacattctcctcttccggatggcacatgccccctcaatctgacctgaagtcccttcctcctggccccctcttccttccacgtagaacccctggaactgtcattcttgctgcctcctgcttacgtggagagccctgtgtccctttcacatctccatctaccagtcaggctcttgggcagcagcgtacctgacttagggcctgtaccacaagtcgtttctatcaggctgaatagagccaccgttttttgtgtgtttgtttggtttggtttgtattttttgtagagatggggtttcgtcatgttgcccgggctggtctccaactcctggactcaagtgatcctcacacctcagcctcccaaagtgctgggattacagcgaagagccacagcacctagcctgaggctgactagaggaactgtctctgaaccatctcttggactccagcctgtatgcacagacacccaggttattaccgtctccagctcccagccctaccctgaattcctcagtgcgccgactatgtcaccatcatggccaatatccactcaactgtctattctgcctcgcacctacaaagagccttacatgagtcctctcacttaatctctccaatttactcctcatgacaaccttacatatccccacataagcaggaaactgaataattattttaaaatacagtgtcgttcttgtactaaaaaccatctggctgcccgatactgtggctcacgcctgtaaccccagcacattgggaggccgaggcgggcagatgtcttgagatcaggagttcaagaccagcctggccaacatagtgaaaccccttctctactaaaaatacaaaaattagccaggtgtggtggcgggcgcccgtaatcccagctactcgggaggctgaaccaggagaattgcttgaaccgggaggcagaagttgcagtgagccgagatcacaccactgcactccagcctgggcaacagagtgagactctatct

SEQ ID NO: 1597 - DNA, 1699 bp, Homo sapiens
agtgactcctgtgccccaccatggacacactttgctccacgctcctgctgctgaccatcccttcatgggtcttgtcccagatcaccttgagggagtctggtcctgtgctggtgaatcccagacagaccctcacggtgacctgcaccttctctgggttctcactgaggactaatggagtgggtgtgggctggagccgtcagtccccagggaaggccccggaatggctcgcactcatctcttgggatgatcatacgcgctacagtacgtctctggagaagagactcaccgtcagaaggggcacccccagaaaccaggtgctcctcacactgaccaacctggacccagtagcggacacaggcacctattattgtgcacacactctggcgggagaaatgaatgatccctcctgctacatggacgtctggggcgaggggaccacagtcaccgtctcttcaacacccaccaaggctccggatgtgttccccatcatatcagggtgcagacacccaaaggataacagccctgtggtcctggcatgcttgataactgggtaccacccaacgtccgtgactgtcacctggtacatggggacacagagccagccccagagaaccttccctgagatacaaagacgggacagctactacatgacaagcagccagctctccacccccctccagcagtggcgccaaggcgagtacaaatgcgtggtccagcacaccgccagcaagagtaagaaggagatcttccgctggccagagtctccaaaggcacaggcctcctcagtgcccactgcacaaccccaagcagagggcagcctcgccaaggcaaccacagccccagccaccacccgtaacacaggaagaggaggagaagagaagaagaaggagaaggagaaagaggaacaagaagagagagagacaaagacaccagagtgtccgagccacacccagcctcttggcgtctacctgctaacccctgcagtgcaggacctgtggctccgggacaaagccaccttcacctgcttcgtggtgggcagtgacctgaaggatgctcacctgacctgggaggtggctgggaaggtccccacagggggcgtggaggaagggctgctggagcggcacagcaacggctcccagagccagcacagccgtctgaccctgcccaggtccttgtggaacgcggggacctccgtcacctgcacactgaaccatcccagcctcccaccccagaggttgatggcgctgagagaacccgctgcgcaggcacccgtcaagctttccctgaacctgctggcctcgtctgaccctcccgaggcggcctcgtggctcctgtgtgaggtgtctggcttctcgccccccaacatcctcctgatgtggctggaggaccagcgtgaggtgaacacttctgggtttgcccccgcacgcccccctccacagcccaggagcaccacgttctgggcctggagtgtgctgcgtgtcccagccccgcccagccctcagccagccacctacacgtgtgtggtcagccacgaggactcccggactctgctcaacgccagccggagcctagaagtcagctatgtaacagaccatggccccatgaaatgatcccggaccagatccgtccacacccgccactcagcagctctggccgagctcacagtacaaccacaataaactcttgttgaatgaactct

SEQ ID NO: 1598 - DNA, 1664 bp, Homo sapiens
tttgaaatgagacctttgctctggagtccggcagggctcagaccctgctcaggacaagcccctaggaccagtggacactgcctgtggtccgagtgggtccctgtgccctggggcagttggcccaggaatgaggcgggtggggcgggggtgacagaggtgggccaaggggacactgcggctctttggcacccagtccttggtggtcagcaccccggtgaggtgcacacgcccacgggggcgctttccctgctcgcaggaggatgagatgcgcccaggatttcaacaagcaccgagatcaggccgggtggggctgtgtgactcccggctgtcccccagccacctatgctgcccacgcgctaggcccatttctgctggtcctggaggtggggccctgggggtgggggccctggtgacctcagcgcccctccttgctatccccagggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcctctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctactaaaaatac

SEQ ID NO: 1599 - DNA, 3180 bp, Homo sapiens
cattttttattgtgaaataatttaaacataagattgagaataatatactatctgtagaccatccaccaacatcatcaaaccttagtattctgccatcttttcaagttgattttaaaagaataaagtaatagaacaaaatcctatggagacaaattttttatttgtgtggaaaattcccagaaacagctctacctgcagtggggtaggagttcccctgggtaacaccctgtaatgccaagagaggttttaggattgagtttcagggtggagtccagaaatgggggtgtaaagtaatcgtttcaaagaagtgtagtctcaagtgtcgttgggttgttagggttggggaaaggagagctgcagctgtgaatgtaaatatatagatcactcgttcagaaatcagggctgcttgtcacaaatgcagtgctgccaggttcctgagatcatacccacataccctcctagtgagagagtctgctaggatggggagcatcaaaactggcttatctttgtgcctctggggtgtttgcacaccaatttatatttaccatagtaatatagtatgtaaagcttagtaggttaagaaatgttaaaataaaacttagatttatcctagattatgtttttgttaaaacttggccattctttggaaacagaactattttaagtattctattagcctgttattttttcctgaagagactttgttgctattgttaatatttatccctaccttttctttaaagcaatagagttaatgaagggaagtatatttatttatacctgtattctgtgttcttgctactagaagtgtaacttggggaccagcagcttctgtatcaccagggtgttggttagaaatgcagagtgactccaccccatagccactgggtcagaacatgcattttaacaagtgattgcaggttcaagtttaagagatacatgttctgtgtatgtgcacactgttaaatttttatagaatttaaatgctgtgaatgcggtaggaaaatcgattcatttttgatccactgttcttagaagcaggctactggatgcctacccaatatataacataaatatatgtattttctgtcaaatcctttatgagcttcatttttggtaatatttgatgacatatcagttatattcaaaatttctgatggtctctctctctctgtctctctccctctcctcctctgcccctctctccctctgtcccctgtgacttgcatcatttttcttgaagacattccattattgttccattgacctttccctcatcactgagtcctttggagctgagttatgtcaacagctgccttaattactttggtcagaagtggtgggaaccaggtgagaaggagagtgctgctaagctcccgcctgctgcaggacgacaggcgggtgacacccacgtgccacagctccacttcagagcctaggtgttctcggtttgacccagatggtagtgggagtccagctacctgggacaattttgggatctgggataaccgcattgatgagccaattctgctgccacccagcattaagtatggcaagccaattcccaaaatcagcttggaaaatgtggggtgcgcctcacagattggcaaacggaaagagaatgaagatcggtttgacttcgctcagctgacagatgaggtcctgtactttgcagtgtatgatggacacggtggacctgcagcagctgatttctgtcatacccacatggagaaatgtattatgtatgtacaatgactttcactcctgactttgcagttcctatacttcctacttaaactttcaccctttggctgaggcttccagcgtaaacatagttacttgagtggttgcatgctgctgcttcacgaatgagcagtagtttaagtgtgccatttattacttatggttatcacaatttcagaaatgcatgttttaacaactcccctggggaaagcattaaccaaaatctatagcacttaatttgtgatcattttaagtgaagtggcataatgtacatgagataacctatgagaagcatttactcccatcagtgtaggacagataagtgcttcagtaaatggtaattactctttcaagtggtgtgaatagctttgaatacctgacttgttgaaaatagctttggatgattggcattagtgtggaaaaatgcatttaatgcaggcattttggagctcttccgtttatttacttcaactagtattaatgcatttttgaggatcacattactgctaaaattgaaagagggagaacatgtgatggagttacgaccatgtgactatttttgacttcccagtgaccatttcttgacttcctgtgtttaccgcattccacgaaagaactcacaatgggaaggaactctcgacctctcagggttgtggtagtgaggatcaattcttcaaggacaaggacttggactttcattgtcgtgcccttaaaagcttatcacagtgcctgatactttgtggattctcaataggtattccttagccagtaggtcttcagcatttgacaggaaaatcctgaggcccgttgtgtggaatgactgctagctagagtaacagtgaggagaaaaacctattgtaaaatgattgtttaaggctctttttttcctccccacaaagggatttgcttcctaaggagaagaacttggaaactctgttgaccttggcttttctagaaatagataaagccttttcgagtcatgcccgcctgtctgctgatggtatgtaaaactaccacattccttggatcctagggagtacatggggtgggggaggagtaaaaaggaaacactttaagtcctttgggggaggggattttaatggacaattgtttgtaaggatttatgtagaaatgagtttatatgaagaatcacattaaatgctgttgggaactccaattaatgttaatacctcacttttaaatgaaatatattggagaatttttcagaaagagaagccccgaaacagttctgatgttgtactttagtttttaaaagattttaaaaatgtttaatctgtttgcttattttatggacaaaatgtccatactatgagttttgttttgggtttttggttttttttttagatggatctggtgaccaagtgctgaaatacactacagggtaatcacatctagcgaggacagtcattgtccaac

SEQ ID NO: 1600 - DNA, 2334 bp, Homo sapiens
gtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctgctaaagttcaaagttcacatcagtgtagccagagtgaagcatctttgttagcagttatgtggtcagaaaacaactagaatgggagcacacctggtgcccagattttggtttccaataaaaggaaccaggactccttagaaaatgaactgattctagaactgggatatgaactgtacaagatgagcctagagtatcttgtgccacagaaaaatgaagtactgaaattaaaaaaaaaaatcatagtgattgggagtatgtcagcatgatcgaactgaaggatctctgaaaggccacagctggagcaatttgagtaacaaaataaagtagtattgggttataacccaaactatataataaatatttacaagcccaaactaatataaatgattgaatgggaacaaatctcttgtgcagaagaatttcaaataatttatgtagatactccccacttagtgggctctgcatagtgacttccttgcagagtataatatggaaaggggggaaaagagtaactttacagtggagaaatctgacagacaccagctcagccaggtgattgaggttaacatcatccatgataagcccttttgatagcatgtatccttgatagcatcacatcatacagaatgtgataagaatggcactttacctctgtggtcctcctccccagaactcagaacccaagtctgatcaggagaaaaacatcacacaaattccaattgagaagcattctttaaaatacctaaccagtacttctcaaaactatcaaggccataaaaaacaaggaaaatctgagacatggtcacagccaagaggagcctgagaagacatgactgctagatgtaatgtggtatcctacatggaattatataccacgaaaagaaaaaaaggtcatttggtagaaactagggaaatctgaatacagtgtggacttcagttaatataaatgagaaaatggtttcattggctttaaagggattttagaatatcttactttgcatagtttcatgagcactggccaggaggttataaactggcatttaggcctctctgccatttagtagcagtatagtcattaagcaaagcattactctggactttattgtcctgtttctatcaaattggactaacaaaaattgatataatacattcatcacagtattgttaggagatttaaatgaattagtgaatgtaagatactttagaaagcatgtaaagtactagaaacaatgaggtggcttcaattagtgctcattctgagacctaaatttaaagggtcaggcattagaaacaaaagtgtttcttcatatctaggagatttggaaattctgaactaaggtcttataagaacaagaaatgagcaaagtgttcattgtagatactagggaaaagctttgttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaacctcgtctttact

SEQ ID NO: 1601 - DNA, 2186 bp, Homo sapiens
acagtcgtgtgaggagctatggagcacagcagtaatcgcccagaggacttcccgcttaacgtgttctctgtcactccgtacacacccagtaccgccgacatccaggtgtccgacgacgacaaggcaggggccactttgcttttctcaggcatctttctaggactggtggggatcactttcactgtcatgggctggatcaaataccaaggtgtctcccactttgaatggacccagctcctcggacccatccttccgtcggtcggagtgacattcatcctgatcgctgtgtgcaaattcaaaatgctatcctgccagttgtgctcagataacgaggagagggtcccggactcggaccagacttccggaggacagtcgttcgttttcactggcatcaatcagcccatcaccttccacggggccaccgtggtgcagtatatccctcctccttacggttctcaggagcccctgggaatgaacgccacctacctgcaacccatgatgaatccttgcggtctcatacctcctagtggagcagcggctgccgcaccaagtccccctcagtactacaccatctaccctcaagacaatgctgcgttcgtggagagtgagggcttctctcctttcgtgggcactggatatgacaggcccgactctgatgctgaccagctagaagggacggagttggaagaggaggactgcgtatgtttctctcctccaccgtatgaggagatatacgctctacctcgctagagactgcaatgctaaggggacggacatttaaaccctgtgatgtgatacttggagagtttatcgctgtgttcttcagaagttaggtgtcaaagcagctcaggagatcttacagatgtcattcaaggtgggaaagaagtgccccgagactgctaaattaagctgccctggttaaattcccctctgctctggttttgaattctctcagctaagaaaccctctgcagctggagagtcgctctgtgatagagtgattttggagcccacgcagtgccttgggtttgatctctagagccagaagaaaacaaaaacaaaaacaaaaacaaaaacaaaacaagacctctctacataaagtgcaggaggaaaattcacccatttccccatcccccacccgatatccatttgaaggatatcttagttgtgaaagattgtcttagttttaaatccggcagccatggcagctctcagactgatgaaagggaggctggcaagcaagcagggaagagagcaggctcaggtagaaatttccctgcacggcgctgaaccttccgcagcagagtgacttatcttagacaacttgggctgttatctggtctccctggaagcctttggatcttgaagagtttgttaaagaaataaaatccattaagaaataaatgaataagtagagtgggatgaaacagtgccccatgttagaatagtgttgggtggccgatcctactgtggacgaggtaacaggaggataatgaatgtcaccatgtgctgtccaccgagttacagtgacccctgctcctgatggttttcctttgcaaggctgaagttcaaggcgtaatgtacatgggtgagcgcctgctccctctgcccacccccaggctgtgattcccaggcacgaactagctcagccgagtggcttacagaacgcaggtacagctgagtggcttatggaacacaggtatgcctctgatctgttccacagagccatgctgccgtgtcgctttgtagtcatgaatcatggagatgatcagtcatcccgtctcccccaccccccgcccccgggcgtagctctcaccttcatttgaacaaagaaaagctggtagccttcagcttcctaagtctgaacggtgtcaccaaccacagcccaaagctgcagactttaggaggtgtccaaagaattagaaagaaaacagttttacaaagatcaaaggccactcaaggtaaaggtggctgcccccaagagagatacaggaattgtcaggtcttgaaggttttggtactgcgcttatatgtgggattgcttttactctctgtcagaagagtccaggtttttcaaggatatcagcaaaacaatcttggtttattattgtgattcatattatgcctcagggacatttcacttggatgataactagtaataaaaaactagacatgtctatactcagt

SEQ ID NO: 1602 - DNA, 1993 bp, Homo sapiens
actcatttataccaggaaacagacaagagaacaagaggctgccgaagacaaaacttctctgcaagcacctgtgcacagcaatgtgcgtgggcatctgtgagaagaagagaatctgtgaagtttgagcaagcggccttcccaagatgtaccgaatatctcaactgatgtcaacaccagtagcaagttcttccaggttggaaagagaatatgctggagagctgtctcccacgtgcattttcccaagtttcacctgtgattccctggatggttaccattcttttgaatgcggctccatagatcccctgacaggctcccactatacctgtcgccgaagtcccagactcctcaccaatggctactatatttggactgaagacagcttcctgtgcgacaaagatggcaacataactctgaacccatcccagaccagcgttatgtataaggagaacttagttagtacctccaaatcttggctgcatggaagtatctttggtgacatcaactcttctccaagtgaagacaactggttgaaggggaccaggaggttggacacagaccattgcaatggaaatgcagatgatttagactgttcttctctgactgatgactgggagtcagggaagatgaatgcagagtctgtgatcacctcctcttccagccacatcatatctcagcctcctggaggaaactcccatagcttgtctcttcagtcccagttgacagcttctgaacgtttccaagagaatagttcggatcattcagaaaccaggttgttgcaagaggtcttctttcaggcaatcctgcttgctgtgtgcttaatcacttctgcatgtgcaagatggtttatgggagaaatattagccagtgtcttcacatgctcattgatgataactgtagcttatgtgaaatcattgtttctcagccttgccagctatttcaaaaccactgcctgtgctcggtttgtcaaaatttgacaaccatttaggaatgccttcgatgaatgtcctccatctgaatatctggaaattgtccaacttgcagtctacttggaatcaagtgttttattggaagggagtaagcgagtaatggagaaaaagccattttagtttgactatgtgattttaaaatgatctcagtttttccatcaaaattataatatgctcatgaaaataatattaatttgccttccctttgcaaacaccggcagttgaaaggaaaaggacggggaatgtgatggaaaagagaccgcctggaataaatgtccccctatgattctttaaggcagtggttctcgagcttgaattttcattaggaaattctgtgaggagcttgtaaccagatttctgggtctgccacatgcacctatctcttgctgaattgctttaatagaataatgagagcaagtttgtctaactaataccaacctgacaacttgaataacaataaatgcaatttgtacataaaatataatgctgcaaaagtttgtcattcacctcagtggagtgacttgatattaggtggtaaccgtagatgatggttaatatgaaaatggacaggaaagaagcattttctgaaagttatattcttttgaaccacgttctaaaccaagtttttaatcttcttggggctcgtaattacctttcactttaatgtcacttaaagatataacacagaaaaatgccttgagggcaaaatataggcaaaacaccaatgcgctttcaaatgcatgaaaatggtgcagttgtacccttgagccttgactcaagggctgtagatgttccctttccaccccccacacttggtgcgtgttcacaaagcaaatatggcctgtaattcaaatttgttctatgtgatactctctgagtaaaaactcatacatgcagaaaattgtctttgctcgaaatgataatgccaaaatataactttatatataatttgcatttagtacatttttggttaaaaaataaactaataaataagtgaagtcatcagc

SEQ ID NO: 1603 - DNA, 2818 bp, Homo sapiens
tttggagcctggcgactgctttgggaagtcctgctggcaggcactctgcccctgggggtgtgcaaagagttgtccagttaccttgatcttctcacagcctcctccccagggcaccgggagagaccaggattggaggacggtaaagaacacacttcccagaggattcttggaggtggcttcctccaggcagtaaatctacagcccaggctccctgcatcttatggctccaatcactttggatctcatcgtcgcctgcacattgccatacacagggaaggagaagagatggagaaggcaaagactttctgaaagccgtggctaaaagctggcatgtgtcacatcagctcacattccattgtagagacggggtttcaccgtgttagccaggatggtcttgatatcctgacctcgtgatccgcccgccttggcttcccaaagtgctgggattacaggcgtgagccaccgctcccggcctggcaggcattcttgaggcaaacgggaaatgggtgaacgggaggaacattggcagcacttgtggtctgcaccaagaactgaatcgaatttccatgtgttattgaatgttcacaaagaccttgtacagcgagtgttactacctctggtcaatgattcatctcaaggctcagaaaagtcaagtgtcttgtccagggacacttagtcagaagtgaatccaaggtttaagctcaagtctgcctaactctgaatttcacagccttttgctacatatggcgaataatatatccctgaacactaaaggcagactccaaggatcttgtctctgcaatcatcattctggccataatttatgaaaagcaacccaaagtatgtgatgtaataagtactatctatgagtttacccttccaaaaattgaactgaattctgagctctaaatttggaatcaaaagaacttttctctgcactaatcatttggaacatcacttaaagaaaacaacgaaaaactggtgtcccctgagagaaagcaatacaaaacattatgcataaagaaatccttccaaaaaataaaccaaatccagtcaaatctctagttttgactcctagcttaccggaaatacgtgatgggaaaaaaatgaaatgacaccactatgattcaatcagccaaatccagcatatgcaaatttctaccagataaatggtttagtttcttccccaaacaaatggcacaaggaaacggagatggagttcccctctgccacccggactggagtacagtggcgcgatcctggccatcgcgacctccgcctcccaggttcaagcgattctcctgcctcagtctctcaagtagctgggatatgggcacctgtcaccatgcccagctaatttttttaaaatttatttttagtagagatggggtttcaccatgttggccaggctggtctcgaactcctgacctcaggtgatccacccacactttttattgtttgcctacactttctagacttgcttcatcagcctactccgtttctggttgatgtggtttggttgtgtccccactcggatcttatctagaagtgtaatccccaagtctcaagggagggacctggtgtgaggtgattggattggggggtggttcccgccatgctgttctcatggtggtgagtgagttctcatgagatctgatggttttgtaaggcagttttccctattcttgctcactcttctctctctttctgccatgtgaagaaggtccttgcttccccttcaccttctgccatgattgtaagtttcctgaggcctcccctcagccatgcacaactgtgagtcaattaaacctctttcctttataaattactcagtctcaggtcgtatctttatagcagtatgagaatggactaatacactggtctatccttcatccaaattaactacctgcactgcagtccttgtctcaggctctgctttgagggaccccaactgtgacagccgcattagaatgcatcacatactgcagtgaaattctagagtgggtgttgtcaggtggtgatgattgttagatatgtcagtctgttttcaggctgctgatggggacatacctgagactgggtaatttatgggggaaaaggaggtttggtggactcacagttccacatggctggggaggcctcacaatcatggcagaaggtgaagggcacggcttacagggtggcagcaagagaggaaatgagaaccaagtgaaaaggtttctgcttgtaaaaccatcagctcttgtgagacttattcattacaatgagagcaatatgggggaaactgcccccatgattcggttatctcccaccagatccctcctacaacacatgagaattgtgggtgctacaattcaagatgagatttgagtggggacaaagtcaaaccatatcattagataggacactggagaaaggcaagaaagaaaagacatctgaagaatgaagggagccaaagaaacgccaacattttgctttttgaagaaaagctaaattaaagtcaaaatggatttatcaatttccttgggttcgtgaatgtacagaactttattaagactgtcatgctgtcatcatggctggatctgatacggccaccgtggaccttgaggtgacctcgggaatggagacagtgcatgggagagaatcacattggaaggggcctgggtttctgaagaccctgtaagacagatctccttgcagccctgactgcccacattagggcttttatgttagggtgaagttaccttgcattgtcatataagcaattgctatttgtggtgtcttgcaaataaacctattctgatctagtatgtttcct

SEQ ID NO: 1604 - DNA, 1789 bp, Homo sapiens
tttttcctgcagctcctgcgtaaaggagcatgagagcgtgggagttttgcagtggccgtggcgttcttcgtcgcgtctcggtcgggcgtcgctttctgcagctcctgtcagggagcgcgaggcctgttattaaccgcggagcgctttgtcacgaagtccctgtggcgtcttgaagaaggcattccccacccgccaaatggcgtccatgcccccgacgcccgaggcccagggaccaatactgtttgaggatctggctgtgtatttttctcaagaggagtgcgtgactctgcaccctgcccagaggtccctcagcaaagatggtacaaaagagtctttggaggatgcggctttgatgggagaggaaggcaagcctgagattaatcagcagttaagcctagagtctatggaacttgacgagcttgccttagaaaagtaccccattgctgcaccccttgtcccttacccagaaaaatcctctgaggatggagttggaaaccctgaagcgaaaatattaagtggaactcccacttacaagagaagggtcatcagccttttagttaccattgaaaaccacaccccattagtagaactctctgaatatttaggaaccaacacactttctgaaattcttgattctccctgggaaggagccaaaaatgtgtacaaatgtcctgagtgtgaccaaaacttcagcgatcattcatacctagttttgcatcagaaaattcattcaggagagaaaaaacataaatgtggtgactgtggaaagatcttcaatcatagagccaacctgaggacacacaggagaatccatactggtgagaaaccttataagtgtgccaagtgcagtgccagctttcgccagcactctcatctatcccgacacatgaatagccacgtaaaggagaagccctatacatgtagcatatgtggtagaggttttatgtggctcccaggattggcacagcatcagaaaagccacagtgctgaaaacacctacgaatctactaactgtgataaacattttaatgagaaaccaaatcttgctttgcctgaggaaacattcgtatcaggcccccagtaccagcacactaagtgcatgaagagcttcaggcagtccttatatcctgccctttccgagaagagccacgacgaggactctgaacgctgcagcgatgatggggacaatttcttctcattctcaaaattcaagcccttacagtgtcctgactgtgacatgacctttccttgtttctctgagcttatttcccatcagaacattcatacagaggaaaggccccataagtgcaaaacatgcgaggaaagttttgctttggactcagaacttgcatgccaccagaagagccacatgctagcggaaccttttaaatgtaccgtgtgtgggaaaactttcaagtcgaatttgcatctcattactcataagcgaactcacataaaaaacaccacgtaaagtaaatataacaaattgttattagtgattgggcttttcagtatctgtatggtgggaagcagttactgtatatgtcccaggcaatgtgctaagcactttacacacattcccatgtaatacttaattctcagcacaaccttgatttaggcagtatcatttccattttataagtagggatgcaaaatccgtgtcactaaactagtgaatgaacccaggatttgaactcagttactgtacaactgtgagccagaagaagatacacaacttttgtttaaattcaattttcattaaaatgagggctcttgctaaagttatttt

SEQ ID NO: 1605 - DNA, 2402 bp, Homo sapiens
agttggtgagctagggtagcgcactacggttcactcttgctttctttgcttcacaggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctg

SEQ ID NO: 1606 - DNA, 2387 bp, Homo sapiens
agtcaggattctagatttttctctgtccagcctgttctctccggggcacctgctctctctctctctctccctctctcctagcacctgctgctcagtaggaagggcaagagcaattcgaggcggtgcattgtgaggagtctccacccctcctcctgcgcttccttctccagggagcctctcaggctccgcccttacctgcccgagataattttagtttccctgggcctggaatctggatacgcagggctcgctctatattctcccgcctcaacattccaaaggcgggatagcctctctaccatctgtagagaagagagaaaggattcgaaatcaaatctaagtgtctgggatctctagacagagccagactttgggccgggtgtccggctccttctgttggaggtgctccaggtgccatggaactggatctgagcccgactcatctcagcagctccccagaagatgtgtgcccaactcctgctacccctcctgagactcctccgccccctgataaccctccgccaggggatgtgaagcggtcgcagcctttgcccatccccagcagcaggaaacttcgagaagaggagtttcaggcaacctctctgccttccatccccaaccccttccctgagctctgcagcccaccttcacagaaacccattcttggtggttcctccggtgcaagggggttgcttcctcgagactccagccgcctctgtgtggtgaaggtgtacagtgaggatggggcctgccggtctgtggaggtggcagcgggcgccacagctcgtcacgtgtgtgagatgctggtacagcgagctcacgccctgagcgacgagagctggggactagtggaatcccacccctacctggcactggagcggggtctggaggaccatgaatttgtggtggaagtgcaggaggcctggcctgtgggtggagacagccgcttcatctttcgtaaaaacttcgccaagtatgaactattcaagagccccccacacacccttcccagaaaagatggtctcgagctgtctggatgcacaaacaggcatatcccatgaagacctcatccagaacttcctgaacgctggcagcttccctgagatccagggcttcctgcagctgcggggatcaggccgggggtcaggtcgaaagctttggaaacgtttcttctgctttctgcgtcgatctggcctctactactctaccaagggtacctccaaggaccccagacacctacagtatgtggcagatgtgaatgagtccaatgtctatgtggtgacccagggccgcaagctgtatgggatgcccactgacttcggcttctgtgtcaagcccaacaagcttcgaaacggccacaaggggctccacatcttctgcagtgaggatgagcagagtcggacctgctggctggctgccttccggctcttcaagtacggggtacagctatataagaattatcagcaggcccagtctcgtcacctgcgcctatcctatttggggtctccacccttgaggagcgtctcagacaataccctagtggctatggacttctctggccatgcggggcgtgtcattgataacccccgggaagctctgagtgccgccatggaggaggcccaggcctggaggaagaagacaaaccaccgtctgagcctgcccaccacatgctctggctcgagcctcagcgcagccattcatcgcacccagccctggtttcatggacgcatctctcgggaggagagccagcggctaattggacagcagggcctggtggatggtgtgttcctggtccgggagagccagaggaacccacagggctttgtcctgtccttgtgccatctgcagaaagtcaagcattatctcattttgccaagcgaagatgaaggttgcctttacttcagcatggatgagggccagacccgtttcacagacctgctgcagctggtagaattccaccagctgaaccgaggcatcctgccctgcctgctgcgccactgctgtgcccgtgtggccctctgaggccgcacaagctactgcagccatgggtttgcctaccacctttctgttctgtggactcggtgcaggtgggtggggtggtaaacagtggaagagctcctccccccaattttatcccattttttaaaaacctctctcaaccagtgaaacatcccctaaacctgtccatccctgactcctgtccccaagggaggcattgtggtcctgtccccttggtagagctcctgaggtactgttccagtgaggggcattatgagaggagcggggcagcccaggaggtctcataccccacccgtaatctgtacagactgagaggccagttgatctgctctgttttataccagtagcaataaagattattttttgat

SEQ ID NO: 1607 - DNA, 2562 bp, Homo sapiens
gttaggagcgcagtggcggcgcaaccagccttctagggcggcggaggagtggagtcaacatatcaatggagcaagtcacagtcgtcgatgccagcttcttcttgaaatgtaggagtttgaaatacctttaaaacatccttatcgtgaatcagaatcagccattattggtttttgggagttcatcatttacttgtaatatccacaatgttaatatcacatagtggtactgtatggacaatactatttacaagtaaaatgtttagatctggaaatttcatattgaatattagatgcagtaataatattttgttatttaacatttctaggatacatatatattggtcattatacaaattggtgatttttactagacatagtgaaagatagtatttgatatgtagagtggattaaacagtagcatttttaataatacatgctctaaaaatgtaaaagatacggaaaagagggtaggttattaaaagattctaattcattgtccagcaaaatccttggtgatgaattttttttttttttttttgcttttgagatctttggttttgagttcaggctgctaccatgaaatggaattcctaaagaaactccctgcttaagcagcacacagtgcccattgttcactggagttggaattttcacatatgcctaactctgttggggctattctttctttctaatgtcacaactcaactgtgctcttggtattaatattggagaaggaaaatctgtgctctgttcttgtttctatgtaacccacatttctaattctttgtgcggcacttcctccttacaatttaacaaatagaggaaaaacttaatttcaacattatctgcatttgcaagcaatacaaaacaagtttattctcgtggattattttgaagttctgaaatttttcttttgaaatatctattggaaatgctttaaaactatgtttctaacacttagactctcagataactttactaataaatgatctctattttagaggccaaacaaggctgttttgtgaaaaggacagttttattttaaagttaattttctggtctttttaaagctacccagaatggaaacctgacaatgatacaggacacacaatgtaagttaaattttttaagctaccatttgtaaaggagatcaatgtaaggaattcaggtttcactttcaacatttcataaacaaagtattttcagaatttctttactgaaaatgagactttgataaaattcactttggttaacaatttttagaatatatattatgtagtaatttgtattcttttattgttaatgtagactttgacctagttacttcacagatactctgaaagattgaagtggttgtggtcatatattggggtgctttaacatttaatcttaattctttccaatggacctctttattatgatttatattttatgtcttcactttactaggggtgatccattcatgttgcagcagtctacaaatccagcaccaggaattctgggacctccacctccctcatttcatcttgggggaccagcagttggaccaagaggaaatctgggtgctggaaatggaaacctgcaaggacctagacacatgcagaaaggcagagtggaaactagcagagttgttcacatcatggattttcaacgagggaaaaacttgagataccagctattacagctggtagaaccatttggagtcatttcaaatcatctgattctaaataaaattaatgaggcatttattgaaatggcaaccacagaggatgctcaggccgcagtggattattacacaaccacaccagcgttagtacttggcaagccagtgagagttcatttatcccagaagtataaaagaataaagaaacctgaaggaaagccagatcagaagtttgatcaaaagcaagagcttggacgtgtgatacatctcagcaatttgccgcattctggctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttggtttcaggggagatgtgtgaaggttgacctgtctgagaaatataaaaaactggttctgaggattccaaacagaggcattgatttactgaaaaaagataaatcccgaaaaagatcttactctccagatggcaaagaatctccaagtgataagaaatccaaaactgatggttcccagaagactgagagttcaaccgaaggtaaagaacaagaagagaagtccggtgaagatggtgagaaagacacaaaggatgaccagacagagcaggaacctaatatgcttcttgaatctgaagatgagctacttgtagatgaagaagaagcagcagcactgctagaaagtggcagttcagtgggagacgagaccgatcttgctaatttaggtgatgtggcttctgatgggaaaaaggaaccatcagataaagctgtgaaaaaagatggaagtgcttcagcagcagc

SEQ ID NO: 1608 - DNA, 2322 bp, Homo sapiens
aaaaaaaacttgaagatctcacagacctaatagacacggcctttcctctctgcctctggctttatgtctctttcatcctcctctgcctttcccctgcccttgatcccttctgcaggtcttggctggtttcaggaaacgggtcccatcccatggactcccactctggggagcctgcgctcctgccctgtgggacctgtgacatggttttccgctcctcagctctgttagccacccatactcagcgcttctgcattggccacccgacccaagtgatgacatttggagcacaggcatcagttgccactgaaccccagcgggccgcggtgcagtggctgcggctatccctacaggaaatgcggccctggataacagaggtccccagggtgttcgcggggccctggacacgttccgaggcgcggcctcagagtcccatgtccgaggcggtgggaagccccagcgagcggctgcgggcgctgttcaggactcgcgcgaggcgcgtggcggagatggaagcgcagagccgggccctgcagctacgcggcgaggaactgagccgacgcctccaagttgtggcctgtacgcggggcgggatgtcccgcctcttcggcctggagcaggagattcgagaactacaagctgaggccgggaggacgcggggagctctagaggtgttgggggcccgcattcaggagctgcaggcggagccagggaacccgctgagctcccggcgagaggcagaactttattctccagtgcaaaaggccaacccgggaactctggctgccgaaatccgggcgctgcgggaggcctacattcgagacgggggccgggaccccggcgtgctgggccagatatggcagttgcaggtggaggcgtctgcactggagctgcagcggtcgcagacccgcagaggaagggcaggtgccacctcaggggagcttccagtagtggaggctgaaaaccggcgcttggaggcagaaatcttggccttgcaaatgcagaggggtcgggcacccttggggccccaggatctgcgactcctgggggatgccagcctacaaccgaaggggaggagagatcccccactcctcccgccaccggtggcaccaccgctgccaccacttccaggcttctcggagccacagcttcctggaacaatgaccagaaacctgggcctggactcacacttcctcctgcccacatcggacatgctgggccctgcaccctatgatcctggggctggcctggtcattttctatgatttcctgcggggccttgaggcttcctggatttgggtgcaactaaggactggcttggcacgcgatggacgggatacaggaaggaccacagcgttgcccccagccctttgcctgcccccacctcctgctcccgggcccatgggcaactgtgccatccttgccagcaggcagcctgtgcccagactaccaccctcatcatcagtatctttggtctgtgagctgcaggtctggcaggggctagcatgggctagggcaccacagccaaaggcttgggtctcacttggactatttgaccaagatcagcgggtgctaagtggccgctggcgcctcccacttcgggcccttcctctggaccccagccttagccttgggcagctgaatgggattcctcaggcaggtcaggctgagctctttctgcggctggtgaatgcaagagatgcagctgtacagacactggcagagatcaatccagcaagtgtccatgagtaccagtacccacctccggtgagggcccagctgcagctagggacaccacagctacacataccggtgtggctggtatggctaacggccagcctttattgaccactgtgtgccagtcattaccaatgctttcttgtttgatcctcacatctctatgaagtcctactatgtaacagataaggaaatcaaagcaggagcaggttaacttggttcacagtgtccagcacatcttcactggaagccagcttcctcacccccgcagttggctttgctgatcccccacctcgtacagaagagatgagggtttgggccctcaccacagttctgacttgcccccagtgagtttctgaacccaagtgaatgtggagatgagcatctgaacatgcacaggactggggcctatttccagacctacaggtttactactccatgttctgacattgggtctagaagcatctagcagttgagtacagaaaaccagttccaaccacagctttaccacctcccgttaagtccttaacttttctgtacctcttctgtttttgtaaaacagattaaggattaaatgagtttgtcaggt

SEQ ID NO: 1609 - DNA, 2895 bp, Homo sapiens
tttttttttccgccttctgccagcagaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagagtctgagtaccactatgagtacacggcgtgtgacagcacgggttccaggtggagggtcgccgtgccgcataccccgggcctgtgcaccagcctgcctgaccccgtcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctggtgagaaacattgccataacagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcagtgtcaccaatgttatgaatggcgtggcctcctactgccgtccctgtgccctagaagcctctgatgtgggctcctcctgcacctcttgtcctgctggttactatattgaccgagattcaggaacctgccactcctgcccccctaacacaattctgaaagcccaccagccttatggtgtccaggcctgtgtgccctgtggtccagggaccaagaacaacaagatccactctctgtgctacaatgattgcaccttctcacgcaacactccaaccaggactttcaactacaacttctccgctttggcaaacaccgtcactcttgctggagggccaagcttcacttccaaagggttgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcagatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggattgtggccttatcagatgtttgaatttcagatctttttttatagagtacccaaaccctcctttctgcttgcctcaaacctgccaaatatacccacactttgtttgtaaatt

SEQ ID NO: 1610 - DNA, 2256 bp, Homo sapiens
ctctctgccgcgcgcgcagagccaaggcactgatgtttgaactggaaacttcaaaacgtttaataagagtcttcaggatgggtttgaactagacaagctagaaatttctttagaacaccagctctagcatgcatctcccacttttggctttcctggagaggagcttgaagaggtggttctgcagacagccacagtgatactcaggaaaccagaggaatggatttgacttttctgctaggattctttgttatagtttctccctgagttgtaagaggcatggaaatatacatgaaactgaagaacctgcaaggaagggaagtggaactttccatgctgagtgaaaactaaccaagtggcagttgtgactgaaaacactgaaacctaccacgtccagattcactggattgggggatagaggaacggtcacagctagggagaaagaagtgataccggaaaagaaaacctaaatgaagagaatgaggatgactgcacagtagatggccacctctacctccacagaggcaaagtcagcctcgtggtggaattatttttttctttatgatggttccaaggtaaaggaagaaggcgatccaacaagagctggcatttgttacttttatccttcccagaccctgctagaccaacaggagttgctttgtggacagattgctggagttgtccgctgtgtttctgacatttctgactctcctcctactcttgttcgtctgagaaaactgaagtttgccataaaagttgatggagattacctttgggtgctgggctgtgctgtggagctccctgatgtcagctgcaagcggtttctggatcagctagttggattctttaatttttacaatggacctgtttccctagcttatgagaactgttctcaggaagaactgagcacggagtgggacaccttcatcgagcaaattctgaaaaacaccagtgatctgcataagattttcaattccctctggaacttggaccaaactaaagtggagcccctgttgttgctgaaggcagcccgcattctgcagacctgccagcgctcgcctcacattctcgctggctgcatcctctataaaggactgattgtcagcacccaactcccgccctccctcaccgccaaggtcctgcttcaccgaacagcacctcaggagcagagactccctacgggaggggatgccccgcaggaacatggaaaatggatgttatggagcttcaagaatcgagttacccaccagaaccctaatggagcggcattgcccccgaatgtccagattatccctgtttttgtgaccaaagaggaagccattagtctccacgagttcccggtggaacagatgacaaggtctctagcatctccagcaggactccaggatggttcagcccagcaccatccaaagggtgggagcacatctgccctgaaagaaaacgccactggccatgtggaatccatggcctggaccaccccagatcccacatcccctgacgaagcttgtccagatggcaggaaggagaacggatgcttgtctggccatgatctggagagcatcaggcccgcaggactgcacaactctgccaggggtgaggttcttggcctcagctcctccctggggaaggaactagtctttctccaagaagaactcgacttgtctgaaatccacattccagaggctcaggaagtggaaatggcctcaggtcattttgccttcctacatgtgcctgttccagatggcagggctccttactgcaaggcatctctcagcgcctccagcagcctggaacccacgcctcctgaggacacagccatcagcagcttgcgccctccctctgttcctgagatgctgacccagcatggagcccaagagcagctcgaagaccatcctggccatagcagccaagcccccattcccagagcagaccctctccccaaaagcactgtgcttttcagtggtggctgcgtgaaagggagcgacactcagctgtgtgttcctgggcttgtgtggtacttagaacctcagttctattacgttatagtcagacatttttttgacagtatgagacagactgcaggatgaaaatatttgtcaaaatcttaactgaatgtttactggaagtacttgagattccatttgagagttgtattgttaataatttcatgtcagtgaactgatatctgatgtttatgatatggtgtctttttcttgaaacaagcttccaagggctagaaataaaatagccaaaaaatgc

SEQ ID NO: 1611 - DNA, 2167 bp, Homo sapiens
ctacacgtgatgggcgcccaccgagtgccagcaccgcctcctccagctccgccaagtaggtgggatccactactttgcagaggaggaagccgttcaggcctccctctgtgcactttgcaaaagcctctgcccttccatctcgaatcccttggcgccgatcacacttcctctgcctggaaacctggagccgtctctcgcgagacgtcctccgccctgtagaaggccgtttcggttcttcgtgcgcggtagccgccccatttgcgggattccaaggcctcatcgagtgcgggtatctggctgtggattcgccgccgtcctgctggacgcctggaggctcgaaccccgccgcccccctaccccaggctttactcccaccccggcttccgcccactgtgctgcccttcctcggacctgggctgtcgggagagctggagatgttcacccttcctcaaaaggacttcagggctcccaccacctgtctgggccccacctgcatgcaggacctgggcagtagccatggggaagatctggaaggagaatgctccagaaaactggaccagaagctgccagagctccgtggagtgggtgatcctgccatgatctcctctgatacctcctacctgtcctctagaggaagaatgattaaatggttctgggattcagctgaggagggctacaggacctaccacatggatgagtatgatgaggacaagagccccagtggcatcattaacttgggcaccagtgagaacaaactctgctttgacctgctgtcctggcggctgagtcagcgcgacatgcagagggtggagccatccctgctgcagtatgctgactggaggggacatctgttcctccgggaggaagtggccaagttcctgtctttctactgcaagagcccagtacccctcagaccagagaatgtggttgtcctgaatggtggtgcctcgctcttctctgctctggccacggtgctgtgtgaggccggggaggctttcctgatccccaccccttactatggcgctatcacacagcacgtgtgtctctatggcaacatccggctggcctatgtctacctggacagtgaggtcactgggctagacacacgccccttccagctcacagtggagaagctggagatggccctgagagaagctcactctgagggtgtgaaggtcaaaggcctcatcctcatcagcccccagaaccctctgggtgatgtatactcccctgaagagctacaggagtacctggtatttgccaagaggcacaggctgcatgtgattgtggatgaggtctacatgctgtccgtgtttgagaagtctgttgggtaccgcagtgtcctaagcctggaaaggctccctgacccccagaggacccatgtgatgtgggcaaccagcaaggacttcgggatgtctgggctccgctttggcacgctgtacacagaaaaccaggatgtggccactgccgtggcttccctctgccgctaccacggcctcagtggcttggtccagtaccagatggcacagctgctccgggaccgtgactggatcaaccaggtgtacctgccggaaaaccatgcccggctcaaggctgcccacacctatgtctcagaagagcttagggcattggggatccccttcttgagtcgtggggctggcctcttcatctgggttgacttgagaaagtacctgcccaagggcacctttgaggaggaaatgctgctctggcgccgctttttggacaacaaggtgctgctgtcctttggcaaggccttcgagtgtaaagagcctggttggtttcgctttgtcttctcagaccaggtccaccggctttgcctggggatgcagagggtccagcaggtgcttgcaggcaaatcccaagtggcagaagacccccgtccctctcagagccaggagccaagtgaccaacgcaggtgagctggtcattgtctcgtggccagagggcccagcagccactgtggacctggggcgttctggggctgcagaagactgactgtggatgtgccatttgccaggaaggtatctaacttggctttgtgcctgaagaactgtttcttgtctttcgctgtagcagtgggaaactccttaagctgtggttcagcctgggccctccctctctcctattaaacaaaactaggagagtc

SEQ ID NO: 1612 - DNA, 2009 bp, Homo sapiens
ttcagtgctcttctctccactgatgctgcaggaattctcaaacgacttcccaagagggaaatagacaaagctactgtcagagagagttccagaagaagaccagaagctctgactatgcatcatctatggaaaattccaagacttttcactctctgggggaatgagatttcctgccgtactttccatatgaatatcaagaaactaatacccatacagtggggccaccaggaagcacctgccaagttcaacttcgctagtgatgtgatagatcactgggccagcgtagagaaggctggcaagagatcttcaggtccagccctgtggtggatgaatggcagtgggaaagaaataaagtggagcttccgagaactgagtgaagccagtaaacaaacggccaatgttctctcgggagcctgtggcctacatcgtggggaccgtgtggcagtagtgcttccccgaatcccagagtggtggctgatgatcctgggctgcatgcggacaggccttgttttcatgcctgggaccatccagatgagatcctcagacatactctacaggctgcaggcatccaaggccagggccattgtggctggggacgaagtagctcaggaagtggatgctgtggcccctgactgctcttttctgaaaatcaagttgctggtgtctgaaaacagtcgagaaggatggctaaacttcaaggcattgctaaaagaggcatccaccattcatcagtgtgtggagacagaaagccgagaatcagcagccatctacttcactagtgggaccagtggccctcccaagatggcagaacactcccactgcagcctgggcatcaaggccaagatggatgctgccagctggacaggcctgagtacttctgacataatatggaccatctcagacacggcttggataatgaacattttaggagcgtttctggaaccttgggtattgggagcatgcatatttgtccatcttttgccaaagtttgattcacaaactgttctaaaggtgctttccagctatcccatcaataccctggtgggtgcccccatcatttaccggatgttgctacaacaggatctttccagttacaaatttccacatctgcatagctgcttcagtggaggagagacccttctcccagagactctggagaactggaaagccaagacaggactggaaatccgagaaatctatggccagacagaaacgggacttatctgcagagtttccaggacaatgaaagtcaaaccaggctacctgggaacagcctttgctcactatgatgtacaggtcatagatgagcagggcaatgttctgccccctggcaaggaaggagacatagctatcagggtgaagcccatctggcctatcggcatgttctctggatatgtggacaatcccaagaagacacaggataatattcgaggagacttttggcttatgggagaccggggaatcaaggatccagaagggtatttccacttcatagggcggtcagacgatatcattaattccagtgggtaccggattggaccttccgaggtggaaaatgcactgatggagcatcctgccgtaagcgaaacagcagtgatcagcagcccagacccttccagaggagaggtggtgaaggcatttgtggtcctagcccctggattcctgtcccatgaccgagaccagctcactaaggtgcttcaggagcacgtgaagtcagtgacagcaccctacaagtaccccaggaaggtggagttcgtcttagacctgcccaagaccgtcacaggaaaaattgagcgagcaaagcttcgagccaaggaatggaaaacatcaggacgagcctaggcccagtgagactcctgaggcttttgatggggttctgtcttccccaatcctttcctgtgacttcttcgtctccacttatggagatataagattattcacacagaggcacgtatgtgattttggtctctgtttggttattgacaaagaacaatgacacgtttgacact

SEQ ID NO: 1613 - DNA, 2300 bp, Homo sapiens
tgggtttttcttctcacctttaaaaaaatgagccatttctatttcattttctctgtaactgtctacttaacccttctgaggcttagtctgtacaatggaggcagtccctccttccctcagaagattacagtaagaattggatgaaataaagcctttagctcagtgcctgacacagaagaacatgcagtgaaggaaagctgctattgctccaacaaagatgtaggccattaaatttttaaaaccattttatacatgcacacatacatacaaggactcctctctcctgcaaaaattgttaccttaagtgtggttctctggttctaaggagggaagtgctaagtaagaaagacagggaggtggatattgtggttccccatcagacagaaaacacgggcacctgtttggtaatctttttcttacagtgttattgctaaattcagacagtcttcctaacccacacctgcttttaaaaagcttagctctaacatgaaactgtatgctttttgcttcttggtgttttgtataaaaaaaatcattataaccctgacagtatgttgcttgaggtctccattttactggtctaatactgctgacattcaggaactgagagccatgccccatcagtggtaagagtatctcctatgtgtgcagtggcaaaagctagggaccatggaaagaaacacaaaatatagacacctctgccttttgtcttacagtggcatatcacaaaagactgcatctgaaacaatgttactgcagctttccagtttctcccaaatgatgatgaaggtgaagataggggtgtgatagctaaaacagtgacttcagggccagggagtcctgtatcaaggaagaaagctgcctgcctgtgttccctgtcatttagtcactggctgtgtcataagacatcttaggagccaggttatctccatcagaaagatacctgttgttgtttttgttagcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtggtagaatggcacagagagggaatatccttccacttcacaccagtattggtgtgtaaagaccccattcgaactgtaggccttggagatgccatttcagccgaaggactcttctattcggaagtacaccctcactattaggaagattcttaggggtaatttttctgaggaaggagaactagccaacttaagaattacaggaagaaagtggtttggaagacagccaaagaaataaaagcagattaaactgtatcaggtacattccagcctgttggcaactccataaaaacatttcagattttaatccgaatttagctaatgagactggatttttgttttttatgttgtgtgtcacagagctaaaaactcagttcccaaatccccagtttatgcagcgccatcaggtattttaagctaaacttcttcacccctgagagcatgtcagctggagaaaagcagttcttccttgcccacttgagaagtgcacgcccactcacccaacatcctggtctctaggaaagcctcatgtgaggttcctctttctttcagctcagtgcccatgggcaaggatcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcagg

SEQ ID NO: 1614 - DNA, 2253 bp, Homo sapiens
aaactttaaaagaagaagctccatgcatgacacttaacccattagagagtaaggtttctatgcctgcagtggagaagcgatgagggacacatgaagaacaaccctacttagggtgactttgtgaaatctaagttctttttaaatgttcggtattagactacatggaagtattatttgtctcccatcggagatagtcattcagttccaatggcctttcaggaactcctgaatcaagttggaagcctaggaagattccagatccttcagatctcttttgttctcttcctcgtaggccttgtggtacctcatattacaatggagaactttactgcagccattcccaatcatcgctgctgggcccccatccttgacaatgacactgcctctgataatggcagtaggatcctgagccaagatgacctcctgaggatctccatccccctggattccaacctgagactggataaatgtcgtcgttttgcccaaccacagtggcatcttcttcatttgaatggcactttctccaatgagacagagccagacactgagccctgtgtggatggttgggtgtatgacaggagcaacttcctttctaccattgtgactgagtgggacctggtgtgtgaatctcaggcactgaattctgttgctaaattttcattcatgattggcctatttataggggctatcatatgtggccatttgtcagacaggtttgggaggaagttcattttaacatgtgctttattacaatttgccatcactgaaacctgtgtagcttttgctccctccttcttcatctactgcttacttcgattcctggcaggaatgtctgtggaacccatatcagtaaatagtcacttgctcatgttagaatggacaagccctaaattcctaggcatggtggcagtgcttacatcttgtgctgctagtatcggatacatgatattggcaggcctggcttttctatttagaatctggcgtcacctccagctagcaatgtctgtgccaatattcttcttccttatactcacaaggtggatgtcagagtcggctcggtggctgattgtgaccaacaaaccccagaagggcttaaaggaacttagaaaagttgcacacatgaatggaatgaagaattctggaaataccctaaccatggaggttgtggaagcaagtatgaagaatgaacttgaggcagcaaaaagaaaatcttctccaagagacttgttccacacacccatcttacgaaagcggatatgtgtcctgtcctttatgagatatttatttacaatatctatttttggcctatcacttcacctccaacacctgagtactaatattatcctgttgcagtttctcagtagtgcattgggcatacttattagtgttattggacattttgttcttaatcacatgggacgtagaataactcagctggttctcatgtccctgaggggaatattcatgttgactgctgtatttgtacctcaagaaatgcagaccctgcgtattattatggccacattggcagcagcactttcttctctatgtatgtgtgttagtaatcttcatataaatgagctacttccaaccacattaagggcaacaggtatgggagtcattgcaatgtttggtaatagtggattattcctggcccccctgtttatgctgttagcaacatactctgccaacttgccctggatcttctatggaggcttctctatcctctatgggtttagtgtgtttctccttcctgaaaccaagaatcaacctcttcctgactccatccatgatgtaggaaatgattggaaagagtcaagacaagcaaaggaggaggattccatcattaaagtcacaaggttttgaggaactcctggaattgccatctgatccaagagaagaaaattttgttcaggacatggtgacaattttctcagatgattactcagaattctttttttgatattatcaaacttcttgataaataaagattaaaaagaaaacacagatcacattctaattgctgcaatacattattatatgtcaaatatctatgagcaatatcataattgatttgaagaattaaaaagaacattgaaagaattgaagagtacatggaaagaaatcctgcttgacatttcttgtaatcatgtatacctattatgtttttggatggtatatgtattctatttttctactgctatcatataatacctgaggaaattaaaggaagaaatctttattgttttcccc

SEQ ID NO: 1615 - DNA, 1904 bp, Homo sapiens
gatgcggcccccgcagctggtctctgtggtgctgggagcgagcccagtatagctcccacctcctgcgctggtaacctcccgtcccgcccgcctcccttgttgtcgcctctcctcgcgtcgcggaatccttgcccttggcactacttacatctctccgggtcccacaacaccttagcgcccacctgcttcaaagccaagctccaccgaaagcgaggcagtcagcccccggacatggcctcagcgctgactgatcgcacctctcgggccccgagcacctacacctacaccagccggccccgagcactgccctgccagcgcagccgttaccgggacagcctgacgcagccagatgaagaacctatgcattatggaaacataatgtatgacagaagggtaattcgaggtaacacttatgcactccagacagggccactgctctttgactttgatcttgaagttaaaccagtgttagaagttttggtggggaagacaattgagcagtctcttctggaagtaatggaagaagaagagctggctaacctgcgggccagtcagcgtgagtatgaagaactacggaatagtgaacgtgctgaagttcaacgacttgaagagcaagagaggcgacaccgagaagaaaaagaacggcgtaagaaacagcagtgggaaataatgcacaagcacaacgagacatcacaaaaaatcgccgcccgagcatttgcacagcgttacctggctgaccttctcccgtctgtttttggcagcctcagggatagtggctacttttatgatcccattgaaagagatattgagataggatttcttccatggctaatgaatgaagttgaaaaaaccatggaatatagcatggtgggaagaacagtgcttgacatgttgatccgtgaggtggttgaaaagaggctgtgtatgtatgagcatggggaagacacacatcagtctccagaacccgaggatgagcctggtggtcctggagcaatgacagagtcactggaggcctctgaattcctggagcagagcatgtcacagacacgggagctgcttttagatggaggctacctacaaagaacaacatatgacagaaggtcatcccaggaaaggaagtttatggaagagagagaactcttagggcaagatgaagaaacagcaatgaggaagtccttaggggaggaagaattgtcataggagggaagcttcaaagtcatgaaaccaatcaacagccaagtcagcaagcaatcaggtaatgatgtgcgagtcccctcaggttatagaaattatgttgtatttagtcagtatgtctttttgtgtaatggactgggccaatcaaatgtgataaaattaatttgagaatgaaacttaaattgaattcatttatttaatagaatattcaaaggctatattgtaattctaatgagaattatatttaattactagctttctattaccattatatgtaaccagcaaatatatttttccttagcccttctaattttgcgggttagttttttttagtaagtatgatatttaatgttcaatatcagtgctgtcagccatatagcttttcttctctataggaaaactatttcacctactgtaagagtgaatgcccagccaggcgtggtggctcacacctgtaatcccagcactttgggaggctgaggctggcagatcccctgaggtcgggagtttgagaccagccagaccaacaaggagaaaccccatctctgctaaaaatacaaaattagccaggcatggtggcgcatgcctgtaatcctagctacttgggaggctgaggcaggagaatcacttgaacctggggcggaggttgcggtgagccaagtttgcaccattgcactccagcctgggcaacaagagcaaaactccgtctc

SEQ ID NO: 1616 - DNA, 2833 bp, Homo sapiens
gatatttcattctgcttcctgttttgtcacttgttctttaagatccaagtccttggctccatgtgcatctaatccttgccataagccctgcatcgtacttcatattcaccatattgaactattcaccctcaagtagtcactattaaatgtcacactgttgtagcgactacaaatgcaagctcagtaactgaaaagataacattaaattttgttttttaattggtttcctgtgtcaatttcatgtttcgggaatttgtatggacagatagacaccagagagatatgcgtatttcacctgcatgcttgaggctagagaaacatgatttattcagaactatttcaaatactgtaactaacctggtaattttgtttaggaaaacattaaattcggaatagaaggcaattcagaatacctgtctgttatctttgtcttgtcatttttgagatactcagttcctggaaaatattatgataatccatcttgctatgtagtatttcaagttatatgttgagcctctgagcttgcagagtgaacatttctattcatagacagtgctgttgacatcagtggggagatggcacaagctttgtgccctaggaaagtttaaaagctagaacattacactgcaaaccctatgtcaggaaactttgttgcagcaactaggcaaggaaaccctaccactgtacccataccttgttttagtagaattatgtttctttgctaagaagtctggtgactctcacaccccatctcagcactttcctggattccaaggccctggtgccctgagcacacaacttcccaggttccttttattgtttctgataagaactcgaattagaggcagcgtctggtactcaccaggggtgtggtcccatgggtgacattcttgctccatcatttcttacccaggtaaccttgagtatggcgcctaaatcctctcttcctttcaaattgcctggtctgtaaaatggatgcagtgaatggtagctatgccacaggtgttttgtgtgagaattaaatgagaggagttatatcaataacacttagaggcatgcggtgcctatagtgagggcttgttttatgttgtcgtttaaccctttctttctcagccctcccccactccacatcccctcccactggcaatgtacaaattgcagcttcctgcctctttcctgctatctcgctccctggatgacatccctgcgtttccacctctctctcccctaatcttagctgttttcaccctttccccacagcattgccttgacagttcctcagtgtcccatcccctcttcccatggacaacaccacaaacctgcgcacacggcctgttattattcctcctgtttcacctgtgtccattctgtctcataaaggacactgtaggctctgaacagctaaggcctttcttattcttttgtcccatggaaaataatccctccagatagcaataccaggaatagtgccttttctaacccactggtttccttttgagcttacagccaccaaatcttatatctgtttgtttctgttcccctctctgcattgactgctagagagatcagagtcaagcaggaggttacatctagctggggcactgtgctttatgctggtgtttcgtgtgcaaatctcataccatcttcatgttacagttgttccttagtgtccatgggggatttgtttcagaacccgcaaggacaccaaagtccagggatgctcaagtccctgatataaaatagcattgtgtttgcatataatctacacacatcttaccatataattttttttattatttgtatacattcgtggggtacaagtgtaattttgttacatggatgtattgcatagtggtcaaagtcgaggctgtgagtgtatttatcgttggaataatgtacattgtacccgttcattcctgtatactttaagtcatctctagattacttataatagctaatacaatgtaaatgctatggaaatagttgttatattgttaggggataatgacaaggaaaacacctatacatgttcaatacacagcaattatttttttctgaatatttttgatctgccattgattgaatctatggatgtggaacccacagatatgggacccacagatgcagagggccaactgtgtttattttttccaaatttgtttccctgttatgactcttctttatacacatttttaaactctgttgtcttgtatttcttttctaatcatcttacgtccttttggaaaccaagtggggcataaatagtacatgtttgcatttgaggcaacacagaggcatcgcaggagctggagacagcaaagttcaaagccagtccaccacttacctacagagtggccttgggcaagttacctccattttctgtctccattctcgagcctgtctagagagagaatgaacctgcctcccgaggtgatggtgctgttttaatgaaataatgcatgtgaaatgtgaagtgccactgtccctggcatggagatgctgtccttagatattaggtccatcttgtatcttctagtgtatctttaaaaattaaactatactggcttcatgcctgtaatctcagcactttgggaggccaagaccggcagatcacttgagtccgggagttcaagaccaacctgggcaacatggtgaaaccctgtctctacagaaaatacaaaaattagtggggcttggtggcacgtgcctgtagtcccggctgcttgggtagctggggtaggaggatcacttgagcccaggaggctgaggctacagtgagctgtgattgcaccaataccgatcagcctggtatgacagagcatgactctgtctc

SEQ ID NO: 1617 - DNA, 2108 bp, Homo sapiens
atgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtaagagctctgtccatgctccctaatcacaattgtacttctcctaaattagaggaatgtgcctgtggttgtatttggggtttaaatttcatattaaagtgatgatagccaagaaaattgatttcacgtttcccctctgacatcccagggtaaccccttgaataaatatccctgagatatttgcttgctagacaaag

SEQ ID NO: 1618 - DNA, 3053 bp, Homo sapiens
caggcttttttccttctccttctattaatgaacagacaatatttaaattagcattattagcagtgactagtattcatattctacttgcaataatttcttttttaaaatgatcaggatgagttagatttttttttatagtttattcagaatatttctctgtttgtatccagccccttgactgttgtcctaaatttaaactctccccgtcatttccaaatatttccaagtaggcaatgtagtacttttgtttgtttgtttgttttgtttgtttgtttgtttgagacggagtctcgctctgtcacccaggctggagtgcagcggcacgatctcggctcactgcaacctttgcctcccgcgttcaagtgattctccagcctcagcctccccagtagctgggactgcaggcgtgcgccactgtgtctggctagctaatttttgtatttttagtagagaccgggtttcaccatgttggccgggctggtctggaacccctggcctcgggtgatccgcccacctcggcctcccaaagtgctgggattacagagtgtgagccaccacacccggccagcaatatagtactttttagaaagatttgtagattagagtcccagtatacattgcggctccaacccatgcctgctttggaaaacatattttctctgtgctagtatagtcatgacacatcagcctatatatcctcatgttcagcaagtgcatgttaactgcttttgaaattattattacaataaagtctgttactcaggtgctctcatcagatgttccttcaggaacagaaactgaggaggaagatgacggcatgaatgacatgaatcacgaggtcatgtcattaatatggagtgaagatttaagggtgcaggatgtgcgaaggcttcttcagagtgcgcatcctgtccgtgtcaatgtagtgcagtacccagagctcagtgaccacgagttcatcgaggaaaaggaaaacagattgctccaattgtgtcagcgaactatggctcttcctgtaggacgaggaatgtttaccttgttttcgtaccatcctgttccaacagagccattgcctattcctaaattgaatctgactgggcgtgcccctcctcggaacacaacagtagaccttaatagtggaaacatcgatgtgcctcccaacatgacaagctgggccagctttcataatggtgtggctgctggcctgaagatagctcctgcctcccagatcgactcagcttggattgtttacaataagcccaagcatgctgagttggccaatgagtatgctggctttctcatggctctgggtttgaatgggcaccttaccaagctggcgactctcaatatccatgactacttgaccaagggccatgaaatgacaagcattggactgctacttggtgtttctgctgcaaaactaggcaccatggatatgtctattactcggcttcttagcattcgcattcctgctctcttacccccaacgtccacagagctggatgttcctcacaatgtccaagtggctgcagtggttggcattggccttgtatatcaagggacagctcacagacatactgcagaagtcctgttggctgagataggacggcctcctggtcctgaaatggaatactgcactgacagaaagtcatactccttagctgctggcttggccctgggcatggtctgcttggggcacggcagcaatttgataggtatgtctgatctcaatgtgcctgagcagctctatcagtacatggttggaggacataggcgctttcaaacaggaatgcatagggagaaacataaatcaccaagttatcaaatcaaagaaggagataccataaatgtggatgtgacttgtccaggtgctactctagctttggctatgatctacttaaaaaccaataacaggtatttctacccactcacccttcctcccacggtgatagtgtgatatcctctctgaccttggttgtaaaattcagttatctcatgtgtttctttcccctgtgctggattaagctgattttcgttctttcaagtactgtaagtttttgaaagaaaactggcagtatttgaagttataaagattttacctagaaatgtatttggctattttaattgtatttgacaatatagttttcaatttctgttcatttctgttttgtagttgatgtcagtaacacccaaacaatgcccatgtttgttttcattaatttagcatattgctgtgaggactggttaagccagaaatacttatcattagtgtgatcttggctaccatgtaaaacaatggtttttgcctacttcaagagcttttgtaattaccaaaccgtctaccttcctaacttgctatattaatgctgatgcttgaaagtaagatctttggcatttatgcttacacgttgcatgaagagtaagttgagtacaacatgttatgccatgtattaagtctattaattaaaaacaaattctaagattcaaggagcttttcagtgttccacatttctccctttagaaaaagtaaatgtgtgcagaattaacaaagtgtttaaaaatagatatttattattttactatttggatgaatgtgtagggcagtgcttccttggcactggggatatttcattgagcaaaactaaaaatatcttccctcatggagtttatgttatagtaagacatacgtgtacctctataataactattacgttagaaggtataaagtattgtgaaaaatatatagagcagtagtggagtgggaagaaatgttttgaaatagagcttgagattcttgattgtcttgccctctacttgaacagtgtcttctaggaagcccagacacatggagaagttctgagtgttttggccgatagtcccagatgaggttccagcaacagctgggatcacccatgagatgtgagtgaggaaggctttgagatggtttcagccctagccaccactgacctcataagagaccacaagaatgagaatcacctggccaagcccagcagaccttcagaattcagaaataaaataattcatcttatttt

SEQ ID NO: 1619 - DNA, 3096 bp, Homo sapiens
gagtcgtcctgctctcttcattttctgacctatgcacaagaaagtattttgtgtcagtcatcagcactctagtatgaatttagggtccatgtatattttatttcccaggagataggactgttgaccttctctcaacttgtggagtgacagccttgttctctgtgataggaagtcctagcaccagagagctccaagcaggatagataattttttcgattaggagaggaagaaatccaaaacttcctgtgtgggtcaaattaggggccagagctctacaaggaattctggcctgactccaattaacaaagaaggacgtggagcacaaaagagaaatccaaagtgatatgcaatggaggctgcctctgtctggaagatcttcctgctcttgtgctcccctcttacattctactattgtgtcctcagcctggcaaactcttactcatccctcaaggcccactcaactgtcacctctgagaatccttcctgggctctcccaggtagaattcctctgtcctttatgctctcacagaaccttgaatattcctccattatagcacttactgcagtgataacttgttgcttgtttactcatttatggatgctttccttattaatgtttttacctccagcccctgctcagtggtcaggagctcaaaggtgaacaaaggaatgagtgaatgagtaaggagtgaatgaattagctgccctctgctgacttctgcccttcacccctgtcattctagtccatggttgggttgtaagatttgtccagaataattatccgggatgctggacctctcactctgccatcccaccaccatgtgccagccaagtctcctctcacccacgccaccctcaccatcagtactcccttccaaagttccccatttcccctcaactctccaggcttcagccatctgggcctttctttcctgatgttagtagcttcaatttacattacagttaacttggaacagcgggggggctatatcctgggtcctttctccctccgtctgcttccttctcagtcttcattagtggtgttctgtgagcctcccacccaccccaactctccgagtgctagttaggtgctcaggtttgtgctcttggatgaaactcctgctacataagtggacatagaaaaagaggctggcaagggttgtttccagaggggtctgagccaatcccacgctattgctgggcttgaggttccacatctgtgaatgggaattaagcttcccctgccttcatccaaggtgggatgataattaaatgagagtggatggatgggtcctttggaactcctgaagcaccactggaggcaagggattatcattcttctggctttctctctgtcgaggacttgggtgttcctccagagtcagagggcaggtgcctctggaaggtataatagctaacgtggattgagtgtttacgaccagcccaagcaccctacatggcttaatggatcagagcagccccaggaggtaagggctctttttatcactcacattttacaggtgaggaaactggagagtaatttgatggagatctcacagatagatttcacaggcgattttgaccatgcttctacactggctctgtggccagccccttggcaccagcaccaccactgccatcgatttctggtccacggccagattgctaattctggctccactggctttgccacttgtgagctgcgtgaccttgggcaaatgacttaacctttctaagcatggtctgtgaaatggagagaaggaaacatctccagattttgcccagaggagtaaatggaggtgggatatgtgaagtggctctagacccaggcagtaaacagtgctcagtgtgtgtccttccctattgacactgacagaccctgcctggcaggcctgagcacaacagaagcactagaagtccttttccagaaattccttgctagggcctctcactgtggactgagaggatggaggcaggtccaactcgaggcagggccttgggacaccagtgctcatgagacaactcactgtcatgaccatttccgccttagcgacccagaagtggtgacacctgtgtgcttgcttcccgaagcagtgagaagccagacggagacccacacagctgctggctctaaaggctgctccctgcacgtgggcacctcagccccaccttccattcctctctctaacctgcttcccggacctgctggggccaggagctgccccaagtcctttccacacacacctgtgagctcctgggaatgagattaaaggaggcagggaggtgagaggaagcacaggggaagactgaaagcagatctcagaagctgagaagaggaagatgaagaggaggaagagggagaagggagagtggcagagagaggagcagtagcccgcggagcagggagagaaaaagcaggcagggaagggggaggggtagaggaggggaaggaggagggcctgcacccggctgtgggcagaggctgcggggcctaaaatgaaccgaacaggctggaaatagaacagctgggcaaaccccaaacgctttgtttgggtgtctgctgagcaagcacgtgaatgagaagaaaggggcaacaatgcaaggcagaagtggctcatttcactctggaggcaggtcagaacaagaggcatgtgttccagtccagcacagattagtcggggttctttttccgggatgttttctttacgtaatcattatttttcacaggctggcttggtggcgggattagcctgacgccaccccatccttggcaggtggaaggtttgggttactttgagaccaagaccactctgggttcttattctaactgtggatgccaccggcttcgggagaagagatcttaatccactttctaaatggaggtttaggaatctaagctgtgtaatggaatactatttcccttattagaacaaaccctaactcgggtgcggtggcacacgtctgtagtcccagctactcagcaggctgagatgggaggatggcttgagcccaggagtttgaggttgcagtgcactatgatgcacctctaaattagtcacggcactgcagcctgggcaacatagcgagactctgtct

SEQ ID NO: 1620 - DNA, 2297 bp, Homo sapiens
tcgggtgcctggggcagacgaggccggcttctccgcggacagctagggagagtgtcctgggtgtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggaggggaatgaggaaacatgtaagatggctcgggaagctggagccacaagagtgcacgcctatacctgcgattgcagccaaaaggaaggagtgtatagagtagccgaccaggttaaaaaagaagtcggcgatgtttccatcctaatcaacaatgccggaatcgtaacaggcaaaaagttccttgactgtccagatgagcttatggaaaagtcatttgatgtgaatttcaaagcacatttatggacttataaagcctttctacctgctatgattgctaatgaccatggacatttggtttgcatttcaagttcagctggattaagtggagtaaatgggctggcagattactgtgcaagtaaatttgcagcctttgggtttgctgaatctgtatttgtagaaacatttgtccaaaaacaaaaggggatcaaaaccacgattgtgtgcccctttttttataaaaactggaatgtttgaaggttgtactacaggctgtccttctctgttgccaattctggaaccaaaatatgcagttgaaaaaatagtagaagctattctacaagaaaaaatgtacttgtatatgccaaagttgttatacttcatgatgtttcttaaaagctttttgcccctcaagacaggactgcttatagctgactatttgggcatccttcatgcaatggatggctttgttgaccaaaagaagaagctctaaagaccaactctatggctaaggtcatctgatacacagtgttacataatgcgtacttcaatgaagaaaagtatttttgtctgacagtggaatatatctggagaccacaagtaccactcctattctgttatctggactagaattttcaatcaatgtgtttgaaaataatgttgctatcacctatttggttgagttttggttttttctttttctttttttttccaaaaataaagacagcccatttttgtcatttccattaccacagatgtaagaaagtgataagccatggccatgagctgccctgagctttggtcgttggggaggtggctcaaatggagccagcggctgtggttgacctgccttggggagcagggctgaggggcgaagaggacatgtggatatccagccagaatgccctctctccagaggacacacagctctggatttctacccccttgctatcctctctggccattttgaacctgtaccacctaatgtagaaaaggcccgcctccagtgcccttctttccaaaacagctacacaaatgcttctgaatgccctggatacgcagaccgagtggcagtctggctaaaggcccatccagcactattgtgcccaagagccttaccgggcattccctgaagccccctcataggcagtgatcctagaccaaactcttaaatagaatcacttttgtttcctagaagagatcaaagagtggttgcttcttactttgaagatgaaattataccaagttaggttttttgctatctattgatccaaaaaatatattcgtgcaattaaagttaagtgttcaacttagtatttcaagttgggattcaggttgaggcattttcctgcagaatgggcaattttatgcatttatattcatcagtgctgccctcactttggatctattgtattcttacagtttaatcaactggcaaagtgctttcatgctttggagattaactataaaagcaagattaagaaaaatatgttaattaccatatccctggaactccttctcaggctggtgggggcagccttgcaagagaaacagcagcctttgtctcttccctcttgtggggagcaaggaggggatgagcggtaccttgggagacccggtaaaagtctaaagaattgagaatttgactatcttgggggtaaaatgctgtcataggggcagcagtctcagggggtgtaaactctggaatccactatggtttaccttgagtggcctgcacgaacatgacagccctgatctgtatttcctttccattcagaaaacctt

SEQ ID NO: 1621 - DNA, 2543 bp, Homo sapiens
ttatgcttcagaatttagtttctaatttgtctatgaaagcattttgcatctttttttactcttttttttagaattgatgccatgattgattctcacttaaaattctcagatacttattttgttgaaaaaagatagaataaagatgtgtgccatgtgtgctgtcaccgctatgtgatcattatcagtttcacccactgaactgactagaaaaacttcaccattattacaaaaagtaaccctaagtttcggtaactccactagttcattcagtggatggtgatgtgcctaataatataacatttttattacaattgtgtaatcacattcaaagtcctgttagcaaaaattaacttatgttaaacaaagtaaatctattaaagcatgagtcctcccctagccccaactgaggatcttcatgtatatgtaaacccaaacataaagactccttattcaggtcataggaaagcattttaataattgctatttaagatgattaaacacacctcttgggttttctactaagggcctaatgaaatcctgtatttcaggtgaaatagacagatatgtactgattgacgtaacacttggcaagttggtttaaattatgggccatttttatttttttcccaaaacatttaggcaaattgtgtacataccctatgtcagggaaacagaataacaataatatgaatgcaaagctgtaaagctataattatatggaatatatatattttaaattatctgcaaattggtaacccttaagaagttaaaataaacttacctgtttatattgaataccatttgtagattgctcttttaataggaagactcacattctctatgattttcttaggattgtgcttatatgttatctttttatgaagaagatgactaaaaacattatagatatgtggaaatggctgtttgattataacaattgcataatgacatctgactttatattgcaaccgacggttatcagccaattaccactacagtgtgaaaggtgttaccagaggttctgtataccatatggcctaaaacttttgaggagaaatattttcctttgcttaacaaaggcatatgaagaaaatgttacaaaaatttttattaaaggccaggtgcggtggctcacgcctgtgatcccagcactttgggaggccaaggcgggcagatcacgaggtcaggagttcaagaccagcctggccaacatagggaaaccccatctctactaaaaatacaaaaaattagctgggtgtggtggcgggtgcctgtaatcctagataccctggaggctgaggcccgagaatcgcttgaagccaggaggcagtagttgcagtgagcagagatcacaccactgcactccagcccgggtgacaatgcgagactccatctgaaaaaaaaaaaaatttattaaaagtttaagacatctttctaggttagcttcaatttattactattttacaaggaataaaaatgaaacaatgtgaataactgtgtctttatttacttcacatgtttatttcataagtttaaaatatatctcttgctatttaatactgtattgttaaaatcttgcagctttgtttttcagtgacaggagttgaaattttatataacagtattgcagtttctctgaaataataagtgagcttaacaaaattttcagataggttgagtgaatctttgtgactaaaagaatgatgatctcttttatttaattagcatattaattccttctgttaatttattgagagaaatcaatacaagtaataaccttgggtctcctggtacttgagatcatttgagatatataaaaattgatgtgcatctatcgtttctagatttttatttctgataataacatttgtctaaagagatttgataactgtacttaaattatccttctgtcttctggcatgtacaccaatgagtttattggaatgtgactaaatttgtttcactgtttgaaaaagtatgatgttctacaaaataatatgaatgtgatcaatggataatcttccctagaagcagatattttcaggatgaatcagtgcaatgacggatatatagtgttactgccaagagaatttaagaatatccaattttgaatgtgttaatcattaactattcaagttcttatgggtagaatcaccattgtttatcctaagagaattgccaggtattacatatcatatttgcagtcaaaaacctgagagcctgcttgtggttaaagggacatggatggagccggaggccattatccttagcaagctaccacaggaacagaaaaaccaaataccacatgttctcccttataagtgagagctaaatgatgagagcacatggacacacagaggggaacaacacacactggggccgtttagaggctgcagggtgggaggagggagagaggatcaggaaaaataactgataagtactaggcttaatacctgggtgatgaaataatctgtacaacaaaccctcatgacacaagtttacctatgtaacaaacctgcacttgtaccactgaacttaaaagt

SEQ ID NO: 1622 - DNA, 2034 bp, Homo sapiens
agttaagacacagacacacccatgacctccggattcatcaactgcaagtgagagtaaatggctgggagcaagtgagcccagtgtctgtggacaaagtcgggaccttttttcgatatgcagcaccagataaaaattcatcttcctctacgattggcagcccaagcagcagaacaaatattatacatccccaggtttatttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacaagccagtggtgcttcctgctatcatgccaggggattcgtttgctgtgcctttacacctcacttcttggcggctacaggcccggcccaaaggattgggtgtatttttctgtaggctcccattcattggaccaatgtagtgaagactgcagaaattagtagcagtaaacgagagtgccactctatggacacagaaaaaagccgatttttcaggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacagggttgccactgatcttcagacaggacaatgccaagacagatgctgcaggccagtttgaggagcatgagctggcccgtagcctgagtcctctcttattctgctatgctgacaaagagcagccaaacctctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtattgatgtcaagaaaggccgaggtcgatacattgatacctgcatggtcatctttgccccccgttacctgttagataataaatcatctcacaagcttgcatttgcacagagggaatttgccaggggacagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgagggataccttgggaaaatgcttcttcctacgagtggaaattactctccgaggagctacgtataggatctcatttagtgacacagatcagttacctcctcctttccgaattgacaacttttctaaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctggcttgcaggagggaacaggcaggcctgtggcttccaacaaggccattacctgtgcggagctcgttttggatgtctcacccaagacacaaagagtcatttt

SEQ ID NO: 1623 - DNA, 2588 bp, Homo sapiens
gtaacgcgtcacgggcggcctggcagctggcggcattgaggcggacgcgtctagaggtccgtctgaccgcggcgtcgggacctggtttccgggcatgagctgagagcaccacgccgaggccacgagtatttcatagacattgatggaagcagaaaccaaaactcttcccctggagaatgcatccatcctttcagagggctctctgcaggaaggacaccgattatggattggcaacctggaccccaaaattaccgaataccacctcctcaagctcctccagaagtttggcaaggtaaagcagtttgacttcctcttccacaagtcaggtgctttggagggacagcctcgaggctactgttttgttaactttgaaactaagcaggaagcagagcaagccatccagtgtctcaatggcaagttggccctgtccaagaagctggtggtgcgatgggcacatgctcaagtaaagagatatgatcataacaagaatgataagattcttccaatcagtctcgagccatcctcaagcactgagcctactcagtctaacctaagtgtcactgcaaagataaaagccattgaagcaaaactgaaaatgatggcggaaaatcctgatgcagagtatccagcagcgcctgtttattcctactttaagccaccagataaaaaaaggactactccatattctagaacagcatggaaatctcgaagatgatggttgtgaattactgtagcagcaaaagcaaattggtctccacacctaaaatcgtctgcctgtgtactttgtagatgtgaatggtactattcaacggagcacaatcacatgttagcatttggtaacataatgtttttggatgttcttatggatgtttcttccctaaactatgtatggaattgagcatcatccagaataaatagcgttgtatcccaaattgtgatttgaaccctgggatgctctaattggctggttggtttggatttgtaactccagaaacattctatagtgtgccagagcaaaaggcaaatacacaaaatattatttaaatcaggaaactaaaaatattaacatctattaaaaaattgagcatttttctacgctcgtgtgtcttttacaacataaagaaaaggtaaaaggcagggagggaagtgagagacagattttaaatcatgttcagaactgttgttccagaatttactacggcaatccctccaactggactgaaaaagagaaagttcttggcaaaaaggagctgattctttgaacaaatgttgtagtaatctgtttaagaattatgcttattgtttcaaaatcccaactaggaaaacatggtgtatatcttaaaattgttcgtgttgacaaaactagaatcaaatttaacattttataccacaacacaagttctatttggaaattgaacttttattctatagcaaccatttttttcaaatctaaataaccatgccttctataataacaaatgttgctattatcatgggacttttaaaattacatttattgcatgggattgtttttatagcatgagaatgttctgtttggaattatatcatggtcagtctaaatagaaaaagcaaaatttctttgaaaacctaaacattgctatattggtcactatcaaacatacaattttctaataattgtgtagcggtctaagtggaagagattgcattatcttgtgcaggacgaggagaggacatgcagtgggcacagaaagtcaatggaacagatgccactgtggcaccaagactgtaatgactctgtgtggtaggtagttttaaaggactgcatgccttggaaatgattcttcacttggagaacatacttgcctctagatatgtttgtcactctaagcatcctgaatataacaatagagaaagataagtcaaccaacagatttagggatgtgtttcttcagcacattttggtcattttgatgccaagtttgacatactgtttaattgggcagcacctttgctcctttaccaggtatgtatcactttgttactccaggtgccattcttggtgatgacagaatgtttatcactatcgttgttagcaagaggaagctttcaatataggaacttaacatcttcccatgagtataaatgaatttaagacatttgaatcaaaacttcagtagagggaggttttagaattcataaaactggtttaaggaaattctttttacttttcccaaggttaatctttttaaatatctctagacatcaaatactttctgtatgtattagctgtgtctgtctatgatgcaagtaactctcctcctatttgggggatagttcagagaggtaggagcattatctcccatttttctggtgacttcttggagtatagaattcaccattttatccgtaagtcttcaaaggattatggtggactagaacttacatagtgcaaaatagtcttctatttttaataggaacttagaaaaacttagaattatatatagagttgtttcctttagaaaccagagctatttatttgtatttaaagcactgtttattatttgtactgattcttatccctctgtgtgaataaatgtaagacggtg

SEQ ID NO: 1624 - DNA, 2753 bp, Homo sapiens
ctttctacatatttgtggatttccaaagttttttttttctgctattgacttctaatttcattccattgtggttggaaaacatacattgtatggcttctatcctttcaattttattgaggttttcttttttttttgagacggagtctcgctctgtcgcccaggctggagtgcagtggtactgtctgctcactgcgagctctgcctccgatgttcacgccattctcctgcctcagcctcccaagtaggtgggactgcaggcgtccgccaccgtgcccggctaattttttgtattttttggtagagacggggtttcatcatgtttgccgggatggtctcgatctcctgacctcatgatccaccccccttggcttcccaaactgctgggattacaggcatgagccaccgcgcccggacttattgaggttttcttaatggcctagtgtatggccttgaagagtgttccgtgtgcgtgtgagaagcgtgtgtgtggttgttattgggtagagtgttctagcctgcttatgaagtccagctgtagtgttgttcttatcttctggttctttgttgatcttctagttgttctatcccttattgaaagtggggtactggagtctccaactgacatacttttcttttagctttttattttggaaaatttcaaacatatatgaaagaagagataatgtacttactcatcacccagcttcaacatttatcaacatcttgccaatcttactgaatctatccttccttaccttttttaaaaatgtttcctagagtgtgtcaaagctcatcccagatgtcctaatgtttctagtaaatgcttctgcacaattctaaaagacaaggatgtttttaaacccagccccgacactatcatacctcacaagattcatgctaattcctcagtgtcttctagtcccaagtccatgctcaagtgtccccccctgtccaggcaccctcttcaggggtcctccatgtttcatagcgagaaggggccctgagagttgggcaccccgggcaggctggctggagggggctttggaaaggaaggctttggccagcgtgtgagggtgcaggtctcaccagctcctgtttggtctgtttcaggaacaaatgtggtatctggggcttgcggtctgagaagatggaaactgttagcggctacgaggccaaggcaggagaggctaggggtggggggctgggggtaggagatgaggtccaggaactcagctcctctccacatccatcccagagtagcccctgggctctggaaaccctgagcatttgtgggaactcagcgggcctgagtgcccagcccctgcggagtacacagggctcacccacatcatgggcccctacccagggtaccgagatcaaaagaggagtgtgttcctcttgaccctggggctgcatctcctcgttggtgacttcctggggttcagaccctgccacctcctccattttggggagcaagatctcatctgtctctgggacaggaggacctgggttctgcactggtgaggctgagtgtggggagcaggctctgagcccccagctccccgtgtcccctgctccccaggtgtacagtgccaccaacgtggagctggtgacacgcacacgcacggagcacctctctgatcaggacaagtcgaggagcaaagcggggaagactccattccagtccttcctggggatggcgcagcagcattcctcccacaccggggcccccgtgcagcaggcagccagccccaccaaccccacagccatctcccctgaggagtacttcgaccccaacttcagcctggagtcacggaacattggccgccccatcgagatgtccagcaaagtacagaggttcaaggcaacactgtggctgagtgaagagcacccgctctccctgggtgaccaggtgacccccatcatcgacctaatggccatcagcaacgctcactttgccaagctgcgcgacttcatcactctgcgccttccacctggcttccccgtcaaaattgagattccccttttccacgtgctcaatgcccgcatcaccttcagcaacctgtgtggctgtgatgagcccctgagctccgtgtgggtgccggcccccagctctgctgtcgccgcatcagggaaccctttcccgtgcgaggtggaccccaccgtgtttgaagtgcccaacgggtacagcgtgctgggcatggagcgcaacgagcccctccgggacgaggacgatgacctcctgcagttcgccatccagcagagcctgcttgaagcgggcactgaggcggagcaggtgaccgtctgggaagccctgaccaacacccggcccggtgcccgccctcctccccaggccacggtttatgaggaacagcttcagctggagcgggccctccaggaaagcctgcagctgtccacagagcccaggggcccaggatcccctcccaggacacccccagcccccggtccacccagctttgaagagcagctgcgcctggccctggagttgtcttcacgggagcaggaggagcgggagcggcgcgggcagcaggaggaggaggacttacagcggatcctgcagctgtcactcactgagcactgagccatagccccgggagggctggccaggccactccctgcccgcttttgtaatttatttatttataaactctctgctgctgagcttggggcctggagccccaggaatgagcaggcaggggagactgagatggaaataaagagactgtcgcagc

SEQ ID NO: 1625 - DNA, 2263 bp, Homo sapiens
tattcttcctgatcctctccctcctccaatcctccaccttctgagaggctccaggtctgtggttctttccacgtagtctcatcatttagaagtgagaacatgcagtatttgcttttctatccctgtgttagggttttcatctctcgctagttaataatatagaaattctttgatactagctgataagtacctactaccctgacccctttgagtgttcctgactgcccttgccccggcccccaggcctccttgaccttcagcaactagaaggataatttctaaacattttgtctattaccatggccttaatgtggtgggccacccattctgattggtcacatggtaaggactatggatggaaaactgagaattctatgccctgttgaggttagttcaggaacaactttttgtgaatcttgaggaatgaacattacagcagagctgttcctggtgatgcgtgatctgttatccacgttacttcccgggagtttagttgtgttctctgcaggcagcctgaggtcagggacccaagctccccagtcaggttggactgtacctccttcagtgagttgttggcaactaggcagtgaaatgagggagtgaccgctcatggctcatgaactttgcaagttgtgcaactcaactgtcccaccttgaaagggctcaggaaggtaaagagtgttgttttgggacacagggattgttgcatttaaatctttgtgactgtggtttggtctcagactggtttttcatgcataagttcttcttaccctcaggcatctgggattttacctgtttttcttccagtggtgtgccctctccgccacattgtggagcgtgctttctcaatccttcaggaagaaattcaaagactttgttttttaacaatatgcaggatgggcgtagtggctcatgcctgtaattccagcactttgggaggctgaggtgggtggatcacttgaggtcaggagtttgagaccagcctgaccaacatggtgaaacgctatctctactaaaaatataaaaattagctgggtgtcatggcaggcacctgtaatctcagctgctcaggaggctgaggcatgagaatcactttaccctgggaggcggaggttgtagtgagctgagatcgcgccactgcactccagcctgggtggcagagcgagaccgtctcaaaaacaaaaaacaaaaagcccaacatgcattgctagtaaaatatggaaaacataggaacaacaatgataacaaaatagccaggcaggtatagtattaaaaggaatctctaaatggggattgcaactccccatagcattcaatcaacaaaccactgttttggtttcaccccagagccctgctatacttagaagagttcttgacacttaataggtggtcaagaaatgaatgcattaaatactctagtatttactatttttttctttaaggtatccaggagactcattattaaacagtccctccatctgtattggttgggatattaaacaaaaatcgctgactggctgaaatgacattaatacctattgcctgtatatatcttctctgtttttaaggcaggaagcatctattcatttctgcaacaacttttgtgtggccaatatgttaggtaaatgccaggttcgagagacactgtgcattctaggcaggaggaaggatattccaggcagaagggagggctttgcaagagcacagaaatgcaagacaggtgcctgtggaggtaccagagagcctttatttcctttattacccgcatccttgtgtcaccaggtcctctcattacgacagcctgtctgtcactagaatccgcccgctgcccttcatgcccaccgccaccaccctggaccaccccaagcctgcaacgccttcctgactggctgtccttccttttgccctgccccgtctccagtctgtgctctctacactcatcagaatgaggttctaggccaggcacagtggctcacacttatcatctcagcactttgaaatgccgagctggcaggaggaggaagaggatcgcttgagctcaggagtttgagaccagcctggacaacataatgagaccccatctctactaaaaattaaaaacaaaacaaaaaacaaattagctgggtgtgatggtgcgtgcttgtagtcccagctactcaggaagtaaaggtaggagaatctcttgagcctgagactggggctgcaatgagctatgattatgccactgcacactagcctgggtgacagagcaagaccctgtgtc

SEQ ID NO: 1626 - DNA, 2521 bp, Homo sapiens
cttggcaagcagacatcatggagactatacacagacgtctcacaagggggatgactgcaaatccagtattgcttactgattttatggcatatactagtggcattattgcaataatagagggaattttaaaacaaaagtagaaaacattgccctacaaatcaactattttttcattcctttcattctttagccttctgcagatctttttatacagccattgtagtgtagaaacacattgggatccaagttacttttatttatttaaacttggaatataaatacttccccacacagctacaaagctgtgatactacttttagtggcagtatagtattccttcagttagccattcagcacatgtagaagaaactctttccaagtttttttatgtattttaacaaaagtattttgactattattttaacaaataatgtgtgatcagctttgcacatgcaatttctctttccttccgaatgatttctttcagttctgaagcacaggataatttccaggtatcaaataatctttatagccttcaactgccagagtcaaacagccatcgtggttaatggttaatgattgcattgcagttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcgggcacctgcgggcttgtgtgcttttccctcagagacaacggttctttccggttttgctctacacagttccgtatcttcagagctcctgcagaattgtcagggactagtttgtggaaaggtctgagagttcctggaggctataattagctttttgggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatctttgccgtactgtgactgggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaag

SEQ ID NO: 1627 - DNA, 1913 bp, Homo sapiens
ctcgcgagcgtatggcgtgggctcccttccccctctgtgggtcccgcgaggagactctcgggctttgaggtgagacctgaagttccgctggccggtagtgtagcaggaaagggcaggtcctcccgggtcgtgagccagtagcctcctggggtggcaaggtgtagagaggggggcgttgaaaggacacccgctacccggcctgctttctaggggtctctttggattgaggacatcagcagcagtggaagggattttactggagacctgtcactgtcagagccttaaaatatcaccgacggggccttaatgtcaccgaggtagagagaaaagggcagtagccctagagactattgcgacacagtgtgcccctcataagtttttccagggaggggttctgtactgagttgacgccccaggagctgagcaccaggctttgcatccttgggaactcagcaaacgtttgttcagccaattgcaggtagcatggcccagggcttgattgaggtggagcgaaagttccttccagggcctggcacagaggagcggctgcaggagttggggggcaccctggagtaccgggtcaccttccgagacacctactatgacacccctgagctgagcctcatgcaggctgaccactggctgcgacgacgagaggatagtggatgggagctcaaatgtcctggagcagcaggtgtcttaggaccccacacggagtataaggaactcacagcggaacctacaattgtggcccaactctgtaaggtgctgcgggctgacggcctgggggctggagatgtggctgctgtgctgggcccactggggctgcaggaagtagctagttttgtgactaagcggagtgcctggaagctggtgctcttgggagctgatgaagaggagccacagctcagggtggacttggatacagccgactttggctacgctgtgggtgaggtagaggccctggtgcatgaggaggctgaagtaccaactgccctagagaagatccacaggctcagcagcatgcttggtgtgcctgcacaggagacagcaccagccaagctgattgtgtatctacagcgtttccggcctcaagactatcagcgcctgctagaagtgaacagctccagagagaggccacaggagactgaagatcctgaccactgcctgggctaggggtgtcacttcctagaaggggaagggaactctgggtctaacggagtccactcctgggcccactgtgcctctcccctcagtgtcccttctgacagtgactcctctctctccagcgctgcctgtttcttccccctcctctaagctactcttccttgagccctccctggctgcttcctctcgctcatccgtcagatgcaatctgtgggccgcccctctcccctggccgctaagcagcctccattgatttccgctcgtgtttataggatttccacttagccgtgatcagtagttaagcacaggaaaatcccttgccaccccccctcccttggtcgatgccattgattctgccagcggctcctaaaccgccttacagctgagttagaagatgaggagaggcagcagggatttccctgccttgggatgtgggaaacagaagaaaagttgaggaaatggttgggaatcgctgttagaactctagaaattctaatctgactttgccactgtgcccagctctggcccagagggtagagtgcctcctgtggaagtttaggggcaaatttgttccctgacctggagagggttagaaagaaccaacagctgccccctccccgcccccgtgttgagacaggttctcaaggctcaggggaagatgcatacctcctatgtaagaatgctcttcccttgctgttattcatacacactttccacttcaaatatacccaaatatggctttcctc

SEQ ID NO: 1628 - DNA, 2042 bp, Homo sapiens
aattacgagcgggcggcgctgcgtttccagggcagaggaaacgaggcgccgcgttggcgcttggacggcgggaaccggctccggagcgagaacgcgcatggactcaccctgtcacccaggttggactgcactggcctcaacctcctgagttcaagtgatcgtcccacctcagcctccccagtagctgggaccatagctgtgcagcatcatgcctggctaattttttaagttttttgttgagatggtggtctcgccctgttgctcaggctggcctcaaactcctgggctgaagcagtcctcccacctcagcctcccaaagtgcttggattagaggcgtgagccaccattcctggctccttggacaatattttattcctcagattaagacacgtccttgggatggggctgcattggataattcaccgaaggcaccgctgaatggagtgggccctcagtaaatacctggaggaatgtgacctggccagtgaggttattttcttttgtaggtgaaaggtgtagcagtcactcggcctacacccacagcatcgaccttgtgaacccagcgacctgactgccttggtctgggttctgcccgcacacattcctcgccaccttcttggtgtctgagaacctccagcttcacctccttttctggacccgagggcctggcggagcttccagctgggaccagacctccatggatccactccagaaacggaatccagcatcgccttccaaatcttccccgatgacagctgcagagacttcccaggaaggtccagcgccctctcagccttcgtactcagaacagccgatgatgggcctcagtaacctgagccccggtcctggccccagccaggccgtgcctctcccagaggggctgctccgccagcggtacagagaggagaagaccctggaagagcggcggtgggagaggctggagttccttcagaggaagaaagcattcctgcggcatgtgaggaggagacaccgcgatcacatggccccctatgctgttgggagggaagccagaatctccccattaggtgacagaagtcagaatcgattccgatgtgaatgtcgatactgccagagccacaggccgaatctttctgggatccctggggagagtaacagggccccacatccctcctcctgggagacgctggtgcagggcctcagtggcttgactctcagcctaggcaccaaccagcccgggcctctgcctgaagcggcactccagccacaggagacagaggagaagcgccagcgagagaggcagcaggagagcaaaataatgtttcagaggctgctcaagcagtggttagaggaaaactgagacgtgcacccccatgggatggagacccgaagggactcagacggagccgccgtgttggcagcgcctgggtgtgggcccattttggggaccaaacagcaagctgtggtcggatgagtgccaggacctgtgtaccgggacacgtgggagtcctcccagcatgatgcttgactgacccgaggaaggtcctcatgtttcgtgcctgtcattctcggatggctgtgaggcattccttggcaagggatgctgcgtaccagcggtcctcaccgcatctcacatggctcctgtgatgcatgttgtcgctttcccacccgggatctccatctctcttcccttcctgctgtcagtaagagatcacatgtctgtgtagtgtgaatgccttgtcgctgtcctgtgcttttgcaccattgagttgactgcctctgagaagcagcactaggcctgttgaaatgcaatgtgctgccctgagatccagtttcaagaatgggcaggtaaacgcagtgtgggaaaggaatgtggaatgagaacttggtggttcaccgctgtactatttgtgtaaatgtttacgtatgtgataagctacatgtatgtaaatgttgcaatacccctaacagtcgagtagtagtctcccttacaggaatttttgacggggttcctcatcatcaataccaaataaatatatgtaggaatggaaaaaaaaaaaaac

SEQ ID NO: 1629 - DNA, 2598 bp, Homo sapiens
attccaagtcgctgctgtgcagagcagcaagtgctccgtgcagggctgttgctatcacttggaggtgaacagcctcttttgccggtattcagtgaagaaagcaagtctaaatatgcagttctctcactggagtgaaagatgttttgttcatttctaatcaactatgctagacagctgcaagctgaaaagtgcctgcaatttgccatttatttgtaataagaaaataataaacactgctggaaccagtaatgcagaagtccccttggctgatcccggaatgtaccagctggacattacattaagaaggggtcaaagtttagctgctcgagatcgaggagggacgagtgatccatatgtgaagtttaaaatcggaggaaaagaagtttttagaagtaagataatacacaagaacctcaaccctgtgtgggaagaaaaagcttgtattctggttgatcatcttagggagccattgtatataaaggtatttgactatgattttggactacaggatgactttatgggctcagcctttctggatctgacacaattggagttaaacaggcccacagatgtgacccttactctgaaagatcctcattatcctgaccatgatcttggaatcattttgctctcagtcatccttacccctaaagaaggagagtccagggatgtgacaatgctaatgaggaagagttggaaaagatcaagtaagtttcagacccaaagtttacgcctatcagacctacacagaaaatcgcatctttggagaggaatagtcagcatcaccttgattgaagggagagacctcaaggccatggattccaacgggttgagcgatccctacgtgaagttccggcttgggcatcagaagtacaagagcaagattatgccaaaaacgttgaatcctcagtggagggaacaatttgattttcacctttatgaagaaagaggaggagtcattgatatcactgcatgggacaaagatgctgggaaaagggatgatttcattggcaggtgccaggtcgacctgtcagccctcagtagggaacagacgcacaagctggagttgcagctggaagagggtgagggacacctggtgctgctggtcactctgacagcatcagccacagtcagcatctctgacctgtctgtcaactccctggaggaccagaaggaacgagaggagatattaaagaaatatagcccattgaggatatttcacaacctgaaagatgtgggatttctccaggtgaaagtcatcagagcggaagggttaatggctgccgacgtcactggaaaaagtgacccattttgtgtggtagaactgaacaacgatagactgctaacacatactgtctacaaaaatctcaatcctgagtggaataaagtcttcacgttcaacattaaagatatccattcagttcttgaagtgacagtttatgatgaagatcgggatcgaagtgctgactttctgggcaaagttgctataccattgctgtctattcaaaatggtgaacagaaagcctacgtcttgaaaaacaagcagctgacagggccaacaaagggggtcatctatcttgaaatagatgtgatttttaatgctgtgaaagccagcttacgaacattaatacccaaagaacagaagtacattgaagaggaaaacagactctctaaacagctgctactaagaaactttatcagaatgaaacgttgtgtcatggtgctggtaaatgctgcatactacgttaatagttgctttgattgggattcacccccaaggagtctcgctgcttttgtggtagtggaggacatgctagaggacgaggaagaagaagatgacaaagatgacaaggacagtgaaaaaaagggatttataaataaaatctatgccatccaggaggtatgtgtcagtgtccagaacatcctagatgaagtggcttcctttggcgaaaggataaagaatactttcaactggactgtcccattcttaagctggctggccattgtagccctctgtgtgttcacagccatcctgtactgcattccgctgagatacattgtccttgtctggggcatcaataaatttacaaaaaagcttcggagtccatatgcaattgataacaatgaactacttgacttcctttccagagtcccttcagatgtacaagtggtgcaataccaagaactgaaaccagatccttctcatagcccatataaaagaaagaaaaacaatcttggctagccagctcccagcaatgaggagaccagcatctgtttgggaagataaaagaaaaagccctcagcctcagcagcatttcctttctttctgctttttatttattttgcctttttatcatgatcgagagaatctgtaaatagtgtacaaaggcatatgtctttgaatatatacttctattgtacagactcaacttgataaaggttttgctactgctgtgtcaaaaccttgttagctgtggataataatataacacactgaaagaacaaatataagaatgataacactggaagatatattcttatctaattactagtggattaaatactcacctgtgctctgattaaatctacatcaattgt

SEQ ID NO: 1630 - DNA, 2621 bp, Homo sapiens
aagtgaataaactgccaaggaggagtgtatggatgaaagaggtgggggtaattctgggtatctgacctctaattggaatataatgtcttagaaatcataaacttttcatcttaaattttgcctgaaacattataaataactaagtaaaggatatgaagaggaatacagttaataaaagaaatacggatgaccaataatacaaaaatatcttcaactcaatgttattcaaagaaatgtgaattagaacagtaacgagcaaagattaagaagaataaaaaagccttcatagactgcctataggagtatgtcaataaaccttttttaaaaagtgcatgttctatattctagcaattcttgttttagaaatttgtcatagggaaataattaggcagatgtgtaaagataatgcctactttcttacctcttattttctcttgaactggcctcaatcagatttttgtccctaccactccagaattttatttctgctattcactgaagcagagtcaccagtggcctccacgtaacctaatacagtggtcaggtcttggtcctcatcttaacagtatatccgacatggtagagactctacccttcttgaaatacttcacttttcttatgggaaaccacttcttaccatatttcctggccagtccgtctcattaatctttgctggttcattttcctcttctgacctctaaatgtttgttccccagagctcagttctcagaattcttatgtatctacacttttcccctaatctcatctattaaataatgcatagaccgacctctcccctgaacttcaaacttgcatgtgtaactttcctctttaatctgcacttgagtgtctaacaagaatttcaagcttaacttgtctacagccaaattcttggctctaaaatctcttcttcccttcatcctccttaactcaataagtagcttctccattcctcctgttgcttgggccaaaaaccttcacttaacaatgcctccctcttttccctcttgtcctgcatctgattgatctgtcagcaaattctgctgcttccttcaatatttagccataatccagccacttcttactctcttcattgtccttcccttagtccaagctaccatcctctttcctgggctattgtaatagcctctcaactgctgtatcaacttctcagcttctattcactagtccatagtgcagccatagtcacatgtctaaaccctgtcagattataactttcttatgctcaaaacttccccagtggcttctaactgtactggggaagaaaatccaaagtccttatcatagcccaaaaggccccacatgatctgccccaactatgtctctgagctcatctcttgtcaccctcttattttataccactcttgcttgatttttgagggtgccaagcattatcctacttctaggcttttaaactggcagttctctgtctggaatactctttccctagaaaatttcatgactcactgttttacttcatttgtctctacaagtattaccttatcaaagaggccttctgtcatcacatcatataaaatggctcacagacatgtacgtacatgcacttttcatcactctcctcccctttactctcttgtatttttcctcatagcatttgtcaccgtgtgattgggtatataataggaactcaaatattggtgcaaataagtgactccttaatacaaaatgtgtgagaggtactgtaaaattggaacatagtgttatcggatcttaataatagcttgtagacagaactgtggcatatatctagaaatcaacttttagcctattcttactgacctagagaataataagctctttaaatgacacccttaatgaaaactgtcacataattttcctctaaagtcagcgatattttttaaccatcatattctttatagaattcctaaatctgggtttttgaaaaaagaaactagtgaccatttaaaattgttggctctattcccactgcttctagtggactagcctgaaaaaaatatttttccatgtctgcgtatattttataccttatataatgtcctctctgaaatcatggaggaatttaagaaggagaaaattgataatcatacttacttagtttctttggaatatttgcatttagacacaacatcagtagcagaagcaagacacaacccaagcataggggagggaagtgttggtgggctgactggcagtttgagtgcaagtggaagccacatggatcgaataggagccatccgagacaacctgagtgaaacggccagcaccatggcactagctggagccagtataacggggagtctgtcaggaagtgccatggtaaactgttttaacaggtgtgtgttttggtttggtttggttctgctttctggtaactacaaattattaattaggtgagaattttgaacataaagcatgatgattatatataaccctactatgtcaaggttcaaaatagtaatgttaaaaatgaaatttggggccaggtgcagtggctcacgcctgtaatcccagcatgttgggaagccaaagcaggtggattgcctgagctcaggagttcgagaccagcctgggcaacatggcgaaaccccatctctact

SEQ ID NO: 1631 - DNA, 2605 bp, Homo sapiens
gttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatcagcgagtgggctcctaggcaggtcctgagtgacagcgcggcgggctggatcaggagatgcgcgtgcgcggcccggcccggctgatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcggagtgatcatcaccatgctggtcgccaccgccgtctgctgttacctcttgtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagacgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatg

SEQ ID NO: 1632 - DNA, 1947 bp, Homo sapiens
cagagagagagagaaaaactgctgaccctgtaagagagaactggccatcttgcagacagacagagccccgagtgttctttcaactacctgccacccatccaacaactcccctcggacctcagtatgggctggaacctgacacttggcatgacagtgaccccaggcatccaaaccatgacagttccatcagctctccaaatgagagacggagtctcgctatgtcgcccgggcttgtcttgaactcctggactcaggagatcctcccatctcggcctctcaaagtgttgggattacaggcgtgagctattacacctgacttaagtctccattttcatatctatactttgggattccagaagacagaggtttgagtgtaaaacacaaaataacaaaaccacaacaaaaacaactctgtattctcgtccccaccattaccatctctcccttgtgatgtcaaagagaccagaggaagtggacagactcggggaagaatagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgaaccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccgatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctac

SEQ ID NO: 1633 - DNA, 2156 bp, Homo sapiens
agtgtgttacctgccgacagcataatgtgaggcaaggtctagctgttcccccccggcatacaagcttatagagcagcctcctttgaagatctccaggtggacttcacagagatgccaaagtgtggaggtaacaagtatttactagttcttttgtgtacctactgtgggtgggtggaggcttatccaacactaactgagaaagctcgtgaagtaacctgtgtgcttcttcgagatcttattcctagatttggactgcccttacggatcagctcagataatgggctaacgtttgtggctgacttggtacagaagatagcaaaggtattggggatcatttggaaactgcatgccgcctaccggcctcagagttccagaaaggcagagcagatgaatcagactatcaaaaatagtttagggaaagtatgtcaggaaacaggattaaaatggatacatgctctctatagtattatttaaaattagatgtaccccttctaaaagaacaggatattccccttaggaaatattatatcatgggacccttcccatattgcagggacttccaggcacttcctgagagttaggtgaaattgagttacagcgacagctacaggctttaggaaaaattacacaaacaatctcagcctgggtaaatgagagaccctgttagcttattctccccagttcaccttttctccccaggtgttcgagtgtggatcaaggactggaacgtagcctctttgtgcccatggtggaaaggaccccagactgtcgtcctgatcactcccactgctgtgaacgtagagagaatcctagcctggatccatcacaaccgtgtaaaacctgcagcgcctgaatcctgggaggcaagaccaagtctggacaacccctgcagagtgaccctgaagaagatgacaagccctgctccagtcacacccagaagctgactggtccacgcacagccgaagcatgaggaagctcattgtgggcttcatttttcttaaattttggacttacagtaagggcttcaactgttcttactcaaactggggactattcccagtgtattcatcaggtcagtgaggtaggacagcaaatgaaaacaatctttctgttctatagttattatcaatgtatgggaacgttaaaagagacttgtttgtataatgccactcagtacaaggtatgtagcccaggaaatgactgacctgatgtgtgttataacccatctgagccccctacaaccaccagttttgaaataagattaagaactggccttttcctaggtgatacaagtgaaataataactagaacagaagaaaaaggaatccccaaacaagtaactttaagatttgacgcttgtgcagccattaatagtaacaagctaggaacaggatgtggttctcttaactgggaaaggagctacagagtagaaaataaatatgtttgtcatgagtcaggggtttgtgaaaattgtgccttttggccatgtgttatttaggctacttggaaaaagaacaaaaaggacttggttcatcttcagaaaggggaagccaacccctcctgtgctgccagtcactgtaacccaccagaacttctgaaaaagataaaaaatttgtttctccaattagcagaaaatgtagctcattcccttaatgttacttcttgttatatatgcgggggaaccactatcagagaccgatggccttgggaagcctgagagttggtgcccactgatccagctcctgatataatgggggcttgtccaggatctcatcaggactggatggctctcgctggactatactggatatgtgggcagagagcctacattcagttacctaatgaatgggcagacagttgtgttattggcactattaagccatcctttttcttattaccgataaaaactactggtactatctgtaaattccagacattgtatgagaaagcactgtaaaactttttgttctgttagctgatatatgtagcctccagtcacattcctcatgcttacttgatctatcatgaccctttcacgtggaccccttagagttgtaagcccttaaaagggctaggaatttctttttgggggagcttggctcttaagacatgagtctgccaatgctaccggccaaataaaaacctcttccttcttt

SEQ ID NO: 1634 - DNA, 2197 bp, Homo sapiens
ctgtgcaaagtagatctttttgtcactcccattttagagatgataaactgacacttgatatcatgcccagggtcacacagttcacctgtgatagagccgattcagaaaccggaagtctgactccaaagtccagatgcctaacccctactgaacactgcctttttataaagttcaacactctttatacactctttcagataaagtttccttgaaattggccagacatctaaaggggatgtggtttttggaggccaagctatagaaactagaggatgacttccaaaaataacgatgtttttctgaatgtcgctgcattcctttgtattctcctagttttgactgcttagatctttccggcctctcagactgaggcaagggagaagcaagagaaactcaccccgagccagaagctcaggccagtacagcttactcccctgccaccagagtgaaggtcagccttcaacacagacacaaggagccccagaaggggaggagacgtcatacctctgtccctccccagatcagtctcctggcaggccaggctctctgattcttatctctagttaccccttgtttttctcaaaagaacaggtccctaaaaaaggagggagtttgcatgtctcggggccacctttgctaagcaaatgtctccattctgaatacagaggcaagagttgggttggaggttttgcgatgctgaggtaaactcccagctctcaactccagaggcttagaaaggctcagggcttggtaactggaaccttgcatcgatggagcagaagttggaccgcaggcttccccatggagagctgagcctggtttttcttgggaaagaagttgatctttgccattgtgggagacagccctatccgagacagtgcttctggttcagaattgtggacgcagggcatcctgaaaactggagcggtcctgctgaatttctgggggctaatcagctgcaggccctggccacccactcctgtccttcccccggatgagtgtctccaagtgtactctaggctggtcctccaaagcagccccctgctccccgcatcatcagttttatgtactggggctccgtgtgaggtttcttttgacaggagtgctttccctaaacaaaggtttgggaaacagtctaagactatcgatgtgtgaccagaagacagtgtcattggcctaggggtcattttcccataaggttctcagtgagctaggaactatcagtcagcttgggttacctcaatggaggctttcacacattagaaaaagaagtgtccctttccctgtagaccaggaattcagaacggtcaaagatcgcccaaactgccttcccccctctctagccaaagtcagctgaaaacgcagttggagccaaattcttccccagatactccattttagtcaccaggtaaaagacacaacctggaaattgccacctttgtttacttcctattttccataattctgggtccataaccaccttccaaatgaataaaatccttggtctgaaaatgaagctcgcgtggatcagaatgtcccagtgaccaggaatcaactaggaagctgccttcctagcaggacgtgcggggcagggaggagaaggggaaggaaagggaagaaggtgatagggactgggtcccacaccagaagggctgagtggcctctctccctgcagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacaggtaagatgacatttcctcctctttgcatctcacccacatggtcctctgaccctggcatcccacgaggccctgggagggctgtggagggggcagccatcccaggagctggaaatgctgcagacccctgccatgttctcctgcctcagaccacgggtactgcagcctctggacttgggacagtttctcaagggatgtactttgtcttttttaagggatcatttcagttctccaacccgagtctctcaaaaacaaatcataaccacacaccacccacccaaattcaattagaccctggctcttcaggccagagggctgtggctgttgatttagggaagaaaaaaacccctcatgataataaagtaatcggtttatgtctg

SEQ ID NO: 1635 - DNA, 2291 bp, Homo sapiens
aaaaaggggcgggcgagcacggcccgcgggcggcgttcgctggagctggtggaccgggcggctgaccgaggggcggacgcgcggcggggcagaccgctggggactgcgggcggcgctgtgtccgtcgccatgacagatcagacctattgtgaccgcctggtgcaggacacgcctttcctgacaggccatgggcgcttgagtgagcagcaggtggacaggatcatcctccagctgaaccgttactacccacagatccttaccaacaaggaggcggaaaagttccggaaccccaaggcatccttgcgtgtgcggctctgtgacctcctgagccacctgcagcggagcggtgagcgggactgccaggagttctaccgagccctgtatatccatgcccagcccctgcacagccgcctgcccagccgccacgctctgcgtaagttccacatcaccaaccatgcatgcttggtgctggcccggggagggcaccccagcctgccgttgatggcatggatgtcctccatgaccacccaagtctgctgcagcccaggcctggcatcccctctcgcctcagcccctccccagaggccaccctctggccccgaggggagagtgtggcaggcacaggcagtgcagatgttggtctctgtctcccactttctcccccttcctccgtctctctctcatggcagttttcacacagcatggggcatcttatacgtccactcttgcccttccttttctaacctcattccacggggatcccttcatgtctgtgtggacagcaaccttgttcccacagctgcatggcgctcctaggcggtcccagctggaattacccaaccccatgacggaccctttcattgcagcgatctgcacacgtgtgggtgtttccataggacattgtcaggcacggatggctggtccgaagcacgtgcatttcagttttgaggctcctgtcctcaggcagtgtggactcaggccctgggagtcatgtggatgccagtagcctgggcccacagagctgctgggatgtggggggcatatcaagttgaagatggcaactctgatctgacgcctctgtgctcagggcccctggaggaggggctactgtcccttggcccttagacaacaggacagagaccagagggactgggcggcttgtcccaggctgctgggctgtggtctctgaccccctggaggcctccccacgcctcacagaacacagtgcagacggtgggcggggagagctcgaggggaggcccagccctgcaggtgggactggctctccctccccagccacgagtatgccacagggggctttcaaaaccaggcagggccaagccttggccccactggaggtagagcaccttctgtggctcccgggtgcctttaggcccgtccaggagttggagcagaggagaagacccagactgtgcatagttccctgaggagggctagcctcaggtgccacagcctggttcggcctggcggccccaggacgcagcagcaaccttgggcttcctgcggggtgactaccttgccctccggccctgcccgttgactaactatgctctgtggttttgtttccagagaactcagattgcacagagctagactcgggcagccagagcggcgagctgagtaacaggggtaacacctccctgctgcccctccctctctctccctctctctccctctctctttaccctccccagggctccatctccgcctcaggggcttctccaccccaagtctggctccattcctggccttctgttggtgacagacccccccctaaggtgctcgtttgggggctcttcaggcagcacctcagcctggcacccccactcccctgcacagcccccaggcctcaggaccccacccctctgaggcccaggggagccctgttcacgctggtttctccccaggacccatgagcttcctggctggcctgggccttgctgtgggactggccctgctcctgtactgctatccgccagaccccaagggcctgccagggacccggcgcgtcctcggtttctcgcctgtcatcatcgacagacatgtcagccgctacctgctggccttcctggcagatgacctaggggggctctgacagaccctggacccagggcctcacctgccactcaaccaaagagtcctcgagccggcccgccaaggggactgctgcttctttttctaaatgcatatttttcattatttataatttgtgtaaaaaacacaccttcaccttacaaggtgctgaccatattaaatgttcaagttctctc

SEQ ID NO: 1636 - DNA, 2055 bp, Homo sapiens
gacgccatcagcactgccactctgcccctgccccatcccctaccctgttgtgctggcccgtgtgggctttggtgccagctctgctcagccatggaccctcgacttctctgaacctcagtctcctcttgcagcaaacgggctcatcacagccaggcctggcattgagccatggttgctaggactgtccacctagagggcccagccaggccttttgggtcatgcctctgcccctcaaggctgatggagatggcgttttcagggaggatggatggggtaacgtgaggaaactgaggctcgggagtacagagcctgccccacctgctgcatgaccttgggtcaaccctgcccctctctgaggcctttagcaggtagagaatgggccagagcagctccgagtgccctgcagctctgctcttggattgctccaagcctcattccctccacattcctgactcctgtgtggctatgggccaagcagtctttccttgagcctctgacatccgattctgtgtcatggggttatcagccctgccttcttggtcctgggctgggagtggaggctccatcctggcctggatggggtggcaaagaggtaggtgcccccatccctcacccctgcctctgccaccagtgtcgggactcttctgcctggtgtgggcctgggcctggggggaactgatggagaggctagagggggcgtcctgcagggagaggcctcaaggaaggcaaggccagcacccaccctcaaagggcctctgtctcacccaggagactccatcctcccagcaaggtcagccaataactgtggggatggagtggagccgtgagtgggggcagaggcctagactcccaccccacagggcggtcccgggcaagggctctccatctgcaaagtgcagctctggcccctgctctaggctgctatggctctgggaagccctcctcctgccccttctgggccgctttctctggggtcccccttgccatgtgctatgtgcccaggccgtttctcagggctgcccgctgtgccctactgtgacctcagccactagaacaaacccgagagacctggagggagctcaccagacaggtcagggctgatgatgttcaagcgcatgaagacagtcctatggacttcctggaggagaaagagagagcagtatgtggcacctttgggaggcggcttccaggtttactccctggctccgtgaccccagcccaccctagagccttggctttgaatcccatctccactgcttcgtagctggatgcctctgggtctcctgttctttgagattacactggtgaccatactacatggatgtgcgggtggctagattcctgggtgggagggtggatggatggatggacggacgggccccaagtccaggtggcagctgtctaactggagcaggaactcggagacggatggggacactctgacctgcatgggtaggctgtctccctcctgactctgggagtctcatctcctctggagtcatggtgggaagaaaggcggagaggaagttccaggagctgggaggcccgaggggtgacaggcatgccaggcagaggcgggcagatcacaggaggccagaagttcgagacctgcctagccaacatggtgaaacccgactctactaagattataaaaattagccaggtgtggtggcggacacccatagtcccagctactgggaaggctgaggcacaagaatcgcttgaacctgagaggaggaggctgcagtgagccgagatcgcatcattgcactccagccttggtgacagagcgagacctcgtctctaaaacaagaaaaggagggccagttgcagtggctcacgcctgtaatccccgcactttgggaggctgagtctggagacagcgaagaggttgaggtgttctcgtaaatcagtggtgaaaattcgaatcatctttgggaaagtgggttggcaacatgtattgaaacttcattcattttgacccagtaattccactaatgtggaaatctatcctgagaaaataatcctatataaagaaatgtttcatgcacaatg

SEQ ID NO: 1637 - DNA, 2328 bp, Homo sapiens
ctgccgcagccggaacgagatgtttctgttcactgcaactgtggtttcgtgaaaccagaaggctctagggattacaagctctatggctgctgcatgcagtctaagttcaggagttaccaaattgccaggggttcagtccagggcttattgctcactacacagaagaaagccaatcactgagacaagcatagccaaggaagaaagtttatttgggtgctacagccaaggggaacaggacataagtctcaaatctgtgtctctggcctactaaaattagggatttttatagcagggaagaaatgtaaccatgtgtgggaaacaggaattagggaggggtgaggaagaggagctggtcaacaggaagcggggggttggttaggcatcatggtgggtaaggggtctggtaagcttcaggttttgtttttgttttttgagacagggtcttgctctgttgcccaggctggggtgcagtggtgtagtcgcggctcactgcagcctccagctccaggctcagacaatcctcccgcatcagcctaccgggtggctgggactacgagcgcgcaccataatgcctggctaatttgttttgtattttcaatgaggttttgccatgtctctcggtctggtcttgaactcctgagctcaagccatctgcccacctcagcctctcaaagtgctgggattacaagcatgagccactgctggctttttgatactattggagatgcctgatggttggtttcctgagaaaggaactcagataagacaaatataactttctcgaatttcaagactaggagagttaatttcgacgtttattccaaagaaatcataaacatcagttctgtggcacagttgagccactttcagaaggatataactcaccatcctccctgtgtattcactatagatcttgggggttagcagcggggccatttactgttgtgcaggcctgtgggattccagccggagaagagtcaggcttcccacaccagcaagttatacaaataattaacattcagcaagtgcccactctgcactaggcacatctccaagcactttacactgattttctcatttatcacaacagtccatcaagatatcttattattattcccattttactggtgtgggagcagagacacaaaaacacgaagtcacttggccaaagtgactttcagtgagtggaggagtcagtactcagacgcaggcaagatcatccaaaattcgcctcttctttttttagagaaaggatcttgctttgtcacccaggctgcagtgtggtgactcaatcatggcttacacaaaccttgaacccctgggctcaaacgaccctaccacctcagccaccccaagtaggtaggactacaggtgcacacttccatgcctagcctatttttgtattctttatagagacagggtctcatcatattgcccaagctggtctccaactcctggattcaaggactcttcccacctcagcctcctacagtgttgagattacaggcacaagtcactgcacccagcccaaaacctgcctcttgaccaccagtctgttccatgtatttctaatatgagcaacagctcttagtcatgcattcccaccatccacccacccaaaaggagagcagccaatctggggtcccaagtttaatggaggaagagaatttacccagaatagtttgttcatattcacacagtgattttaaaaacaaaaaaattgattctgctccagaatattctaggtgcattttctgaccttctttttctattgcagattaagaaatggggccaggggagggaaggggggtgtgatttcttttcaggttattttttaatatttatttttaaacaaattccattatttggaggcttctggtgtttagacttcaaatctactaatcttagtccataagtcactcatgggacagtccctaaacatttttccagagacagttctgagacagggtttgtttaaaactctgtgacaaggtgagaaaagatctataagtcagagaaacaagactccatcatctctacaaaaaaattttttaaattattaggtgcgcgtggtggcacatgccaatagtgccagctactcaggaggcttgaggtggggggactgcttgagtccaggagtttaaggctgcagagagctatgattgagccactgccctccagcctgggttacagtgagacactgtctctaaaaaataacaaaatttggggtcaagtgtggtggttcacacctgtaatcccagcaggaggatcgcttgaggccagaagtttgagaccagcctgagcagtatggcaagacccagtctctac

SEQ ID NO: 1638 - DNA, 2050 bp, Homo sapiens
gatgacgctgtagctctccacgtaatcgacgtgttcgtcctgcggctcgctggcgatctgccgcagcgtggccttgtccacgctgcccactccgatggcgaacagctcgacgccgctggcccgggcccgcgcagacacgtcctgcacgctgtcctggggcctcccgtctgtcaccacgatgaccacctgcgacacgcggggcggtgtgacaccgggctcccggaagcccacgggactgtccaggagaggaggctgaggcccggagaggcgggaggactgccgggccgcacagccaggcggcacccgggggaagaggacccggctggccgaagaggagacccgtttcctctgactgagagacgtggctggggggctttccatctgcttcgcctccctcgggcaggcagctctgagatgcccggagggatgtgatgccccatcgccaaattggggtctctaaggtcagggccatgccttcccctcagactgaggcggctgagggcagggtcctcaggctgatggctgtgggagtcgtgccacgccactcgtgcccccgggaggcccggccggggctgggtggggggatccggtggttccacatggtgcagttctgcgctttggccaccagatggcagccgaagctaagggatggggctgccgtctcccgtcttgctgtccttgtccctgtaagaccggggaccctggaccagggaaccgacggagggccactcccatgtggatgcccaagggaccaacccaagaaagatgccgcccttatcctcctccactccccgctatgaaatggccacctcacggggcatcatgggaatcaaagtgtctgcaggcaaagctcataactccgagcgggagcctccaaacagcagcatcctagcagggtggcgtgcacgtaccttgctgatgtcaggggacctggaacgaccaccctctgcatcgccgaaggctttggtgatagcgaactggatggccaggccggtcatggtgcctgtggacagcggctggatacggcgcacagcctgcagcagtgcggccttggagacatgagcccgcagcgagaactcctgcttcacggtgctggcatagttgaccatgcccacccgggtggcattgggccccacgtccagcgactcgatgacctgggacaggaataccttcactttctcaaattcaacaggccgaacgctgcgagagctgtcgacaacaaacaccagggtcacacaagggccatccacggtgaccagcggtgagaaacgcaatgctgtcctcgtgccatgctggaggtgaacgaggagaacgtgagctggggtctcctcaccaactgctccccccaccccaacccccctgacggccagggctgtgtccggggctcagggcacaaggctccgttagctgggcagcagctggcccatgaaacagccctttcagctccacctctgaatggcagttctatgggctcctcggaagaacacaggcgccttctctgtgtcacttctccgctcattagcagagctgcagaaatacactacaggactcaaaattgagaacagtgtgtccggtatgagccagaaggaaaaaaaaatgcacgaaggggccttctgcaaggttgctcacaagtcaaacaggcagctgtgaagggctctgctgttccctcctcctgttttcacatccctcgggcttccagaaacttaaagccgttagtgtttcatgcaagagagagcatctgtgatccacggagaggcccctgggcagtgtggttcagtgggaagcacacaggactccctccccagtgctcccaggatcagctctttccctaaagagcaaacctggttatctcgcaatgacctggctaacacaaatgcaacatcagccggggcagcctgcccccttcactctttgcccaccatcagctgtttggcagtatccatatacgcctttaccagtatttatttaatctttttgtttaattcactctaaaccaactcacttcttaaagatttctctgccttataagaaataatagccatgaaatcac

SEQ ID NO: 1639 - DNA, 2078 bp, Homo sapiens
gagtccgcgggcttccgctcccagcgcgggattctggagggaaattgagggagacttggaaaccgcgccaggcccaccgaggtatcccagaggtgacagaacttgatctgggcctggaaggggaagaattcgggaaaagcaacgtggggcattccagtagtaattgatagaaatattacgtgggataggatttattctctccacacttctgaaccaatgaatagaaaatgggaagcaaaactgaagcaaattgaagaacgagcatctcattatgagaggaaaccgttgtcctcagtgtatagaccaagattgtccaagccagaagaaccaccctccatctggagactatttcatcgacaagctcaagcttttaattttgttaaaagctgtaaagaagacgttcatgtatttgctttggaatgcaaagtaggagatggacaacgtatttaccttgtgacaacctatgctgaattttggttttactataaatccagaaaaaatctcttacactgctatgaagttattcctgaaaatgctgtgtgcaagctttattttgatttggaatttaacaaacctgccaacccaggagctgatgggaaaaagatggttgcattactcattgagtatgtgtgtaaagcacttcaagagttatacggtgttaattgctcagctgaagatgttttgaacttggattctagcactgatgaaaaattcagccggcatttaatatttcagctccatgatgtggcatttaaagataatattcatgttggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagcaatgtcaggttctcagatactttacgaattcttacatgtgagccatctcagaataaacaaaaaggagttggatattttaacagtatcggcacttcagtagaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttgttttttacttctgtaaaccaatttcattaaaaattagctttggtgtaaattcagg

SEQ ID NO: 1640 - protein, 309 aa, Homo sapiens
MCFFFSLQEEFLDKHTLMRVLSSGGKLGSRGEGAQLCCWMLLFSWRVSGGQQTRRLCRRAFCWSPVPSPSCSPSSCLTARSSLCMTFTQSRTTSSLAPVFALFVPFYCSIPRVQVAQILGPLSITNKTLIYILGLQLFTSGSYIWIVAISGLMSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 1641 - protein, 234 aa, Homo sapiens
MAFLAGPRLLDWASSPPHLQFNKFVLTGYRPASSGSGCLRSLFYLHNELGNIYTHGSVLYHLFMCHQGGSAVYARLLALDMCGVCLVNTLGALPIIHCTLACRPWLRPAALVGYTVLSGVAGWRALTAPSTSARLRAFGWQAAARLLVFEARGVGLGSGAPGSLPCYLRMDALALLGGLVNVARLPERWGPGRFDYWGNSHQIMHLLSVGSILQLHAGVVPDLLWAAHHACPRD

SEQ ID NO: 1642 - protein, 205 aa, Homo sapiens
MEGLSDVASFATKLKNTLIQYHSIEEDKWRVAKKTKDVTVWRKPSEEFNGYLYKAQGVIDDLVYSIIDHIRPGPCRLDWDSLMTSLDILENFEENCCVMRYTTAGQLWNIISPREFVDFSYTVGYKEGLLSCGISLDWDEKRPEFVRGYNHPCGWFCVPLKDNPNQSLLTGYIQTDLRGMIPQSAVDTAMASTLTNFYGDLRKAL

SEQ ID NO: 1643 - protein, 170 aa, Homo sapiens [sequence omitted]

SEQ ID NO: 1644 - protein, 530 aa, Homo sapiens
MDYRRLLMSRVVPGQFDDADSSDSENRDLKTVKEKDDILFEDLQDNVNENGEGEIEDEEEEGYDDDDDDWDWDEGVGKLAKGYVWNGGSNPQANRQTSDSSSAKMSTPADKVLRKFENKINLDKLNVTDSVINKVTEKSRQKEADMYRIKDKADRATVEQVLDPRTRMILFKMLTRGIITEINGCISTGKEANVYHASTANGESRAIKIYKTSILVFKDRDKYVSGEFRFRHGYCKGNPRKMVKTWAEKEMRNLIRLNTAEIPCPEPIMLRSHVLVMSFIGKDDMPAPLLKNVQLSESKARELYLQVIQYMRRMYQDARLVHADLSEFNMLYHGGGVYIIDVSQSVEHDHPHALEFLRKDCANVNDFFMRHSVAVMTVRELFEFVTDPSITHENMDAYLSKAMEIASQRTKEERSSQDHVDEEVFKRAYIPRTLNEVKNYERDMDIIMKLKEEDMAMNAQQDNILYQTVTGLKKDLSGVQKVPALLENQVEERTCSDSEDIGSSECSDTDSEEQGDHARPKKHTTDPDID

SEQ ID NO: 1645 - protein, 114 aa, Homo sapiens
MCVCAIHMYSHEDRHGQVLLEEHSSVTSRATGPCRAVVYIVQLWRWNSIFTLFYGAFRVPGFHLRLSVWMAVFRPPLTSLPSILYFGGLLSCYKTFYQVKHRYHLCFHSHWCKY

SEQ ID NO: 1646 - protein, 455 aa, Homo sapiens [sequence omitted]

SEQ ID NO: 1647 - protein, 257 aa, Homo sapiens
MSGFENLNTDFYQTSYSIDDQSQQSYDYGGSGGPYSKQYAGYDYSQQGRFVPPDMMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISALAMEGQQLLVAYPCALLYGVFALISVF

SEQ ID NO: 1648 - protein, 262 aa, Homo sapiens
MKCEPGWPRTPEWPPSPRLSAVGRDKETWAPSAARLGPRAPQLRGVPQSLARDAPGPGSLGRLPRQWPGLCSTRLSGALLSPSDRPPSSPFPPVPGSPFAPSLRPPAWMDAPRLPVRPGVLLPKLVLLFVYADDCLAQCGKDCKSYCCDGTTPYCCSYYAYIGNILSGTAIAGIVFGIVFIMGVIAGIAICICMCMKNHRATRVGILRTTHINTVSSYPGPPPYGHDHEMEYCADLPPPYSPTPQGPAQRSPPPPYPGNARK

SEQ ID NO: 1649 - protein, 578 aa, Homo sapiens
MLSCNICGETVTSEPDMKAHLIVHMESEIICPFCKLSGVNYDEMCFHIETAHFEQNTLERNFERINTVQYGTSDNKKDNTLQCGMEVNSSILSGCASNHPKNSAQNLTKDSTLKHEGFYSENLTESRKFLKSREKQSSLTEIKGSVYETTYSPPECPFCGKIEEHSEDMETHVKTKHANLLDIPLEDCDQPLYDCPMCGLICTNYHILQEHVDLHLEENSFQQGMDRVQCSGDLQLAHQLQQEEDRKRRSEESRQEIEEFQKLQRQYGLDNSGGYKQQQLRNMEIEVNRGRMPPSEFHRRKADMMESLALGFDDGKTKTSGIIEALHRYYQNAATDVRRVWLSSVVDHFHSSLGDKGWGCGYRNFQMLLSSLLQNDAYDDCLKGMLIPCIPKIQSMIEDAWKEGFDPQGASQLNNRLQGTKAWIGACEVYILLTSLRVKCHIVDFHKSTGPLGTHPRLFEWILNYYSSEGEGSPKVVCTSKPPIYLQHQGHSRTVIGIEEKKNRTLCLLILDPGCPSREMQKLLKQDIEASSLKQLRKSMGNLKHKQYQILAVEGALSLEEKLARRQASQVFTAEKIP

SEQ ID NO: 1650 - protein, 284 aa, Homo sapiens
MPLSRLPLRVGQKEFFFPLPLLVPPISWLLLSESQPRLVPGSPVIRPGFQRACVAAACTVAARCPGRGVGDRSQSGASCRPIWGPKVGGPTEMLRGMYLTRNGNLQRRHTMKEAKDMKNKLGIFRRRNESPGAPPAGKADKMMKSFKPTSEEALKWGESLEKLLVHKYGLAMFQAFLRTEFSEENLEFWLACEDFKKVKSQSKMASKAKKIFAEYIAIQACKEVNLDSYTREHTKDNLQSVTRGCFDLAQKRIFGLMEKDSYPRFLRSDLYLDLINQKKMSPPL

SEQ ID NO: 1651 - protein, 393 aa, Homo sapiens
MKRTRDEVDATLQIAKLNAAELLPAVHCLGFGPGASGAAAGDFCLLELEPTLCQQLEDGHSLVIRGDKDEQAVLCSKDKTYDLKIADTSNMLLFIPGCKTPDQLKKEDSHCNIIHTEIFGFSNNYWELRRRRPKLKKLKKLLMENPYEGPDSQKEKDSNSSKYTTEDLLDQIQASEEEIMTQLQVLNACKIGGYWRILEFDYEMKLLNHVTQLVDSESWSFGKVPLNTCLQELGPLEPEEMIEHCLKCYGKKYVDEGEVYFELDADKICRAAARMLLQNAVKFNLAEFQEVWQQSVPEGMVTSLDQLKGLALVDRHSRPEIIFLLKVDDLPEDNQERFNSLFSLREKWTEEDIAPYIQDLCGEKQTIGALLTKYSHSSMQNGVKVYNSRRPIS

SEQ ID NO: 1652 - protein, 270 aa, Homo sapiens
MLSAHWEKKKTSLVELQEQLQQLPALIADLESMTANLTHLEASFEEVENNLLHLEDLCGQCELERCKHMQSQQLENYKKNKRKELETFKAELDAEHAQKVLEMEHTQQMKLKERQKFFEEAFQQDMEQYLSTGYLQIAERREPIGSMSSMEVNVDMLEQMDLMDISDQEALDVFLNSGGEENTVLSPALGPESSTCQNEITLQVPNPSELRAKPPSSSSTCTDSATRDISEGGESPVVQSDEEEVQVDTALATSHTDREATPDGGEDSDS

SEQ ID NO: 1653 - protein, 280 aa, Homo sapiens [sequence omitted]

SEQ ID NO: 1654 - protein, 540 aa, Homo sapiens
MTKHPPNRRGISFEVGAQLEARDRLKNWYPAHIEDIDYEEGKVLIHFKRWNHRYDEWFCWDSPYLRPLEKIQLRKEGLHEEDGSSEFQINEQVLACWSDCRFYPAKVTAVNKDGTYTVKFYDGVVQTVKHIHVKAFSKDQNIVGNARPKETDHKSLSSSPDKREKFKEQRKATVNVKKDKEDKPLKTEKRPKQPDKEGKLICSEKGKVSEKSLPKNEKEDKENISENDREYSGDAQVDKKPENDIVKSPQENLREPKRKRGRPPSIAPTAVDSNSQTLQPITLELRRRKISKGCEVPLKRPRLDKNSSQEKSKNYSENTDKDLSRRRSSRLSTNGTHEILDPDLVVSDLVDTDPLQDTLSSTKESEEGQLKSALEAGQVSSALTCHSFGDGSGAAGLELNCPSMGENTMKTEPTSPLVELQEISTVEVTNTFKKTDDFGSSNAPAVDLDHKFRCKVVDCLKFFRKAKLLHYHMKYFHGMEKSLEPEESPGKRHVQTRGPSASDKPSQETLTRKRVSASSPTTKDKEKNKEKKFKEFVRVK

SEQ ID NO: 1655 - protein, 285 aa, Homo sapiens
MSEAGEEQPMETTGATENGHEAVPEGESPAGAGTGAAAGAGGATAAPPSGNQNGAEGDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPEATEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQGSTNYGKSQRRGGHQNNYKPY

SEQ ID NO: 1656 - protein, 561 aa, Homo sapiens
MVGQILKRDVIMDHHVSTIKPRRIQNQNVIHRLERRRISSGKAGTHWHQVRVFHQNVFPNFTVVNVEKPPCFLRKFSPDGRYFIAFSSDQTSLEIYEYQGCQAAEDLLQGYEGEILSNGNDQRSVNIRGRLFERFFVLLHITNVAANGEHLNRECSLFTDDCRCVIVGSAAYLPDEPHPPFFEVYRNSESVTPNPRSPLEDYSLHIIDLHTGRLCDTRTFKCDKVVLSHNQGLYLYKNILAILSVQQQTIHVFQVTPEGTFIDVRTIGRFCYEDDLLTVSAVFPEVQRDSQTGMANPFRDPFINSLKHRLLVYLWRRAEQDGSAMAKRRFFQYFDQLRQLRMWKMQLLDENHLFIKYTSEDVVTLRVTDPSQASFFVVYNMVTTEVIAVFENTSDELLELFENFCDLFRNATLHSEVQFPCSASSNNFARQIQRRFKDTIINAKYGGHTEAVRRLLGQLPISAQSYSGSPYLDLSLFSYDDKWVSVMERPKTCGDHPIRFYARDSGLLKFEIQAGLLGRPINHTVRRLVAFTFHPFEPFAISVQRTNAEYVVNFHMRHCCT

SEQ ID NO: 1657 - protein, 498 aa, Homo sapiens
MLEEGVLPSPGPALPQEENTGEEGMAAGLLIAGPRGSTFFSSVTVAFAQEGWRCLVSTPRDRFKEGIPGKSRSLVLLGLPVSQPGMNSQLEQREGAWMLEGEDLRSPSPGWKIISGSPPEQALSEASFQDPCVEMPPGDSDHGTSDLEKSFNLRPVLSPQQRVPVEARPRKCETHTESFKNSEILKPHRAKPYACNECGKAFSYCSSLSQHQKSHTGEKPYECSECGKAFSQSSSLIQHQRIHTGEKPYKCSECGRAFSQNANLTKHQRTHTGEKPYRCSECEKAFSDCSALVQHQRIHTGEKPYECSDCGKAFRHSANLTNHQRTHTGEKPYKCSECGKAFSYCAAFIQHQRIHTGEKPYRCAACGKAFSQSANLTNHQRTHTGEKPYKCSECGKAFSQSTNLIIHQKTHTGEKPYKCNECGKFFSESSALIRHHIIHTGEKPYECNECGKAFNQSSSLSQHQRIHTGVKPYECSECGKAFRCSSAFVRHQRLHAGE

SEQ ID NO: 1658 - protein, 107 aa, Homo sapiens
MQPAPRSEAAVGVPCAEGTQKPRGSLPRPHPPPRGDAPYGLGHLHPRTAAGFPSGCDPGEFAISVPPPPPHTAPSRLPVILGCTQRRVCGPGFDGNATREAGSPLLK

SEQ ID NO: 1659 - protein, 305 aa, Homo sapiens
MGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQQQYYSPQAQTPDQQPNRTNGDKLRRSMPNLARMPSTTAISSNISSPVTVRNSQSFDSSLHGAGNGISRIQSCIPSPGQLQHRVHSVGHFPVSIRQPLKATAYVSPTVQGSSNMPLSNGLQLYSNTGIPTPNKAAASGIMGRSALPRPSLAINGSNLPRSKIAQPVRSFLQPPKPLSSLSTLRDGNWRDGCY

SEQ ID NO: 1660 - protein, 588 aa, Homo sapiens
MSGSGRKDFDVKHILRLRWKLFSHPSPSTGGPAGGGCLQQDGSGSFEHWGPSQSRLLKSQERSGVSTFWKKPSSSSSSSSSPSSSSSSFNPLNGTLLPVATRLQQGAPGQGTQQPARTLFYVESLEEEVVPGMDFPGPHEKGLVLQELKVEPDNSSQATGEGCGHRLSSTGHSMTPQSDLDSSSSEEFYQAVHHAEQTFRKMESYLKQQQLCDVILIVGNRKIPAHRLVLSSVSDYFAAMFTSDVCEAKQEEIKMEGIDPNALWDLVQFAYTGCLELKEDTIENLLAAACLLQLPQVVEVCCHFLMKLLHPSNCLGIRAFADAQGCIELMKVAHSYTMENIMEVIRNQEFLLLPAEELHKLLASDDVNVPDEETIFHALMMWVKYDMQSRCNDLSMLLAFIRLPLLPPQILADLENHALFKNDLECQKLILEAMKYHLLPERRTLMQSPRTKPRKSTVGTLYAVGGMDNNKGATTIEKYDLRTNLWIQAGMMNGRRLQFGVAVIDDKLFVIGGRDGLKTLNTVECYNPKTKTWTVLPPMSTHRHGLEMGFPHVDQAGLELLTSGDPPASASQSAGITSVSHLAWPLVQ

SEQ ID NO: 1661 - protein, 122 aa, Homo sapiens
MCYLLLLLIQTAELLIHPQGLQAVSNGESALKGTRPTFSSPFILVTEGRKEWEGVFLSSGWKGNTLSNYYISLVFYYSRILQPYFYCLWGKLEMVTLIRSVWRGINGGDKIQLVLENVKVLK

SEQ ID NO: 1662 - protein, 215 aa, Homo sapiens
MNSSQISLRMKHGRVNMQKKPSKCSECGKFFTQRSSLTQHQRIHRGEKPYVCSECGSCFRKQSNLTQHLRIHTGEKPYKCNECEKAFQTKAILVQHLRIHTGEKPYKCNECGKAFCQSPSLIKHQRIHTGEKPYKCTECGKAFTQNSSLVEHERTHTGEKLYKCSECEKTFRKQAHLSEHYRIHTGEKPYECVGCGKSFRHSSALLRHQRLHAGE

SEQ ID NO: 1663 - protein, 465 aa, Homo sapiens [sequence omitted]

SEQ ID NO: 1664 - protein, 426 aa, Homo sapiens
MAGGHSLLLENAQQVVLVCARGERFLARDALRSLAVLEGASLVVGKDGFIKAIGPADVIQRQFSGETFEEIIDCSGKCILPGLVDAHTHPVWAGERVHEFAMKLAGATYMEIHQAGGGIHFTVERTRQATEEELFRSLQQRLQCMMRAGTTLVECKSGYGLDLETELKMLRVIERARRELDIGISATYCGAHSVPKGKTATEAADDIINNHLPKLKELGRNGEIHVDNIDVFCEKGVFDLDSTRRILQRGKDIGLQINFHGDELHPMKAAELGAELGAQAISHLEEVSDEGIVAMATARCSAILLPTTAYMLRLKQPRARKMLDEGVIVALGSDFNPNAYCFSMPMVMHLACVNMRMSMPEALAAATINAAYALGKSHTHGSLEVGKQGDLIIINSSRWEHLIYQFGGHHELIEYVIAKGKLIYKT

SEQ ID NO: 1665 - protein, 100 aa, Homo sapiens
MDEQIKWFLETASTSGEDAMNFVEMTTKGLEYSVNLVRKAATGYEKIDSSFERSSNLGTLLSNGNACYKEIFSERKSQLMRQTSLSYFKKSSARHGCSHL

SEQ ID NO: 1666 - protein, 411 aa, Homo sapiens
MQVEEATGQAAGRRRGNVVRRVFGRIRRFFSRRRNEPTLPREFTRRGRRGAVSVDSLAELEDGALLLQTLQLSKISFPIGQRLLGSKRKMSLNPIAKQIPQVVEACCQFIEKHGLSAVGIFTLEYSVQRVRQLREEFDQGLDVVLDDNQNVHDVAALLKEFFRDMKDSLLPDDLYMSFLLTATLKPQDQLSALQLLVYLMPPCHSDTLERLLKALHKITENCEDSIGIDGQLVPGNRMTSTNLALVFGSALLKKGKFGKRESRKTKLGIDHYVASVNVVRAMIDNWDVLFQVPPHIQRQVAKRVWKSSPEALDFIRRRNLRKIQSARIKMEEDALLSDPVETSAEARAAVLAQSKPSDEGSSEEPAVPSGTARSHDDEEGAGNPPIPEQDRPLLRVPREKEAKTGVSYFFP

SEQ ID NO: 1667 - protein, 132 aa, Homo sapiens
MLLPRKLTLSYFLALIIAQKEQGLLRNRGSVQPEGMHRAEEDPCGCGLFSRPKDKAVCAGLICTALARMALLRETNRSNAKLPSQFQSQRQARATVQTQLPMSTKKRRKLEMQLVLPCWPLSFSPPGLRRTR

SEQ ID NO: 1668 - protein, 102 aa, Homo sapiens
MRRRLKLSEVTQQPPLKHDKESKDLCWGCQLLFWCPGDEEGIWREDCHPLANVSKKQLSMGEKRGDPSSRNTWPVFHLFIGVDRTSQPFPTSPHHDGWEPGL

SEQ ID NO: 1669 - protein, 852 aa, Homo sapiens
MAPKQKKKTSRGKKRLKPVLAASEDMEPVNMESMGHPEIYPLVLTTKTQEIFNCRIDEDVTDEQPYKLINKEDIFEDLRNRAAVSDFHPVKKIVQEYPGNELLLVYDKDFKYGLNFYLIATEEGKENYLNPPEVPEEQEEYKEHIPEDVYIYKPPVSKPWVSLGSEKEIEEESVTESTKQITYMISRKRSEFGAPIKFSDQNASSVKDAYIECTAYPDKNFTLKQLEKDVGMQVIPQIKDISTQTKCVEIALQQNEIMNTFIDDWKYLAEEEGTFGDKTDTHLKEYQSFTDLHSPTEKMITCVSWHPTIYGLIAVSVAVRLSFEDRVHFSGKLLLQPSLILFWSFSDPIHPQLMLESPDDIFCFKFCPSDPNIIAGGCINGQIVMWDITAHADRIENIKAGGSRSKRATLKPMFLLEPESNKEAMYIRHCAVSSIENGHKKVITDIHWLSDTFEINRMGSVFENRSGICCQLVTCSADCTICFWDIRPQKPLTPQTTEKKKEESIEIPFDVPSTFLHLDLSWKPLTKVRLSKGETSLDHCPTKISLNEDHLLCKTQDKMLAQSKTEKAEEMNPYHNLESGMANLLKPIDDFCTKFFVGTEEGEVIYTDWKMEKDPETGRLMSKKPVSHHTIHDGTVHTIQRSPFYNDIILTVGGWNVAIWKEGVMTGPLLQSCCAPKRYTSGHWSLTRPGVFYIGREDGYIDIWDLLEKTHEPAQSQNICITMITYIKPWIFSSKQQFIATADYYGTLHILEIPWTLSRPSTNEMASVNHYFEREVKHLEYVEQRKKIREQEKKEMELEMAKKKVKTYQKSKEQMQAELKMDYESYLELEKTVLINLGLIKVTEKGSYMEVM

SEQ ID NO: 1670 - protein, 401 aa, Homo sapiens [sequence omitted]

SEQ ID NO: 1671 - protein, 203 aa, Homo sapiens
MQKLGEGEGSMTKEEFAKMKQELEAEYLAVFKKTVSSHEVFLQRLSSHPVLSKDRNFHVFLEYDQDLSVRRKNTKEMFGGFFKSVVKSADEVLFTGVKSTLFCPRRSNLNLSTLGFIFSFSVRREITQLISKIKYKISILSHSQNYTVQFGHQLQVIEKHLTCNLAGTTKEPNFRFYLHTGFQGVSTKTRIQNNVSVTVRGGR

SEQ ID NO: 1672 - protein, 120 aa, Homo sapiens [sequence omitted]

SEQ ID NO: 1673 - protein, 113 aa, Homo sapiens
MDCVTETIRGWCSHAEACAAPALGCCAICSLWTVPGVPTLDFRQASSRVAPARAGANSKSSPGPLCPGSEASLGKRQGQKELGREALKGVESQDKGLGCVPADPQGSSSFGLA

SEQ ID NO: 1674 - protein, 243 aa, Homo sapiens [sequence omitted]

SEQ ID NO: 1675 - protein, 489 aa, Homo sapiens
MADYLISGGTGYVPEDGLTAQQLFASADGLTYNDFLILPGFIDFIADEVDLTSALTRKITLKTPLISSPMDTVTEADMAIAMAKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 1676 - protein, 402 aa, Homo sapiens [sequence omitted]

SEQ ID NO: 1677 - protein, 387 aa, Homo sapiens
MAEPDPSHPLETQAGKVQEAQDSDSDSEGGAAGGEADMDFLRNLFSQTLSLGSQKERLLDELTLEGVARYMQSERCRRVICLVGAGISTCIPDFRSPSTGLYDNLEKYHLPYPEAIFEISYFKKHPEPFFALAKELYPGQFKPTICHYFMRLLKDKGLLLRCYTQNIDTLERIAGLEQEDLVEAHGTFYTSHCVSASCRHEYPLSWMKEKIFSEVTPKCEDCQSLVKPDIVFFGESLPARFFSCMQSDFLKVDLLLVMGTSLQVQPFASLISKAPLSTPRLLINKEKAGQSDPFLGMIMGLGGGMDFDSKKAYRDVAWLGECDQGCLALAELLGWKKELEDLVRREHAGIDAQSGAGVPNPSTSASPKKSPPPAKDEARTTEREKPQ

SEQ ID NO: 1678 - protein, 529 aa, Homo sapiens [sequence omitted]

SEQ ID NO: 1679 - protein, 604 aa, Homo sapiens [sequence omitted]

SEQ ID NO: 1680 - protein, 289 aa, Homo sapiens
MSGHPGSWEMNSVAFEDVAVNFTQEEWALLDPSQKNLYRDVMQETFRNLASIGNKGEDQSIEDQYKNSSRNLSSFQIHQRNHTGEKPYECMECGKALGFSRSLNRHKRIHTGEKRYECKQCGKAFSRSSHLRDHERTHTGEKPYECKHCGKAFRYSNCLHYHERTHTGEKPYVCMECGKAFSCLSSLQGHIKAHAGEEPYPCKQCGKAFRYASSLQKHEKTHIAQKPYVCNNCGKGFRCSSSLRDHERTHTGEKPYECQKCGKAFSRASTLWKHKKTHTGEKPYKCKKM

SEQ ID NO: 1681 - protein, 395 aa, Homo sapiens
MKEDAGMMDVHYSEEVLLELLEQCVDGLWKAERYEIISEISKLIVPIYEKRREFEKLTQVYRTLHGAYTKILEVMHTKKRLLGTFFRVAFYGQSFFEEEDGKEYIYKEPKLTGLSEISLRLVKLYGEKFGTENVKIIQDSDKVNAKELDPKYAHIQVTYVKPYFDDKELTERKTEFERNHNISRFVFEAPYTLSGKKQGCIEEQCKRRTILTTSNSFPYVKKRIPINCEQQINLKPIDVATDEIKDKTAELQKLCSSTDVDMIQLQLKLQGCVSVQVNAGPLAYARAFLNDSQASKYPPKKVSELKDMFRKFIQACSIALELNERLIKEDQVEYHEGLKSNFRDMVKELSDIIHEQILQEDTMHSPWMSNTLHVFCAISGTSSDRGYGSPRYAEV

SEQ ID NO: 1682 - protein, 150 aa, Homo sapiens
MGKLNFRLIVQGQKLLSRKADTSFHLPDNLKAPRSSDSMEPVCPVGWAQRVGQEVGLWAPEPLFHLKLKCFPCYFFFFFFLEMESRSVAQAGVQWRNLGSLQPPPPGFKQFSCLSLSSCWDCRHALPRLAIFLYFSRDGFTMLHRVVLNS

SEQ ID NO: 1683 - protein, 111 aa, Homo sapiens
MPVMQFSFLSSLLLFRRLQHMAPSSQQMLPWFSYQEAGEGKGGQASFFMEQKQWADSLPSRSTHWNVVWLPSLQEVGCTLSAAALPQPKTSQHSCKKRKMARDRQPSLQVQ

SEQ ID NO: 1684 - protein, 536 aa, Homo sapiens
MAVVRLLAEIRTRACLVMAQLLEDSLFCEEFIQQCPAAVEVLNLVAQECSAGERLAVVEVQCERLRMLYRDCARPPPPPLQADRRQPKEITWSPSRVFPPVRACMFSSHLTSVTFLADPSAGGGLPRGTFIYATSPLPVQAPSFYWEIEIVSYGDTDDDTGPIVSFGFITEAEKRDGAWTNPVGTCLFHNNGRAVHYNGSSLLQWKSVRLDVTLSPGDVAGIGWERTEGTPPPPGQPAKGRVYFTYCGQRLSPYLEDVSGGMWPVVHIQKKNTKTRANFGSRPFAYAEGQAHRNAADLCTDLAEEISANFEALPFAMASDSDNDAGTSIASDPGTHGPPCRIAAVATAQQQYDSDTSCHYKVELSYENFITSGPDPHPPPIADDESDDDDDDDIPQEDHYALLVKAWETKVFPTIRRRFRNEAERKSGLDQIKGALQLGMVDIARQTVEFLYEENGGIPRDLYLPTIEDIKDEANKFTIDKVRKGLTVVTRSPDSNNVASSAVGTALPKFAIRGMLKTFGLHGVVLDVDSVSEQPF

SEQ ID NO: 1685 - protein, 109 aa, Homo sapiens [sequence omitted]

SEQ ID NO: 1686 - protein, 312 aa, Homo sapiens [sequence omitted]

SEQ ID NO: 1687 - protein, 333 aa, Homo sapiens [sequence omitted]

SEQ ID NO: 1688 - protein, 105 aa, Homo sapiens [sequence omitted]

SEQ ID NO: 1689 - protein, 501 aa, Homo sapiens
MFSYGMVLYELLSGQRPALGHHQLQIAKKLSKGIRPVLGQPEEVQFRRLQALMMECWDTKPEKRPLALSVVSQMKDPTFATFMYELCCGKQTAFFSSQGQEYTVVFWDGKEESRNYTVVNTEKGLMEVQRMCCPGMKVSCQLQVQRSLWTATEDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRVEMLSSLAWRRILKPSGAESLPS

SEQ ID NO: 1690 - protein, 819 aa, Homo sapiens
MTPLDSRLQAAPAAAAAAAGPKVPPSSLQRRLPYRATTMSEFLLALLTLSGLLPIARVLTVGADRDQQLCDPGEFLCHDHVTCVSQSWLCDGDPDCPDDSDESLDTSRTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRSCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFIN

SEQ ID NO: 1691 - protein, 559 aa, Homo sapiens
MWTNFFKLRLFCCLLAVLMVVVLVINVTQVEYLDHETVSATFIDSSGQFVSSQVTGISRNPYCGYDQQTLSSQERMEEDSLLAALHRQVPDVGPVPFVKSTDPSSSYFVILNSAAFFKVGSQLEVLVHVQDFQRKPKKYGGDYLQARIHSLKLQAGAVGRVVDYQNGFYKVFFTLLWPGKVKVSVSLVHPSEGIRVLQRLQEDKPDRVYFKSLFRSGRISETTECNVCLPGNLPLCNFTDLYTGEPWFCFKPKKLPCSSRITHFKGGYLKGLLTAAESAFFQSGVNIKMPVNSSGPDWVTVIPRRIKETNSLELSQGSGTFPSGYYYKDQWRPRKFKMRQFNDPDNITECLQRKVVHLFGDSTIRQWFEYLTTFVPDLVEFNLGSPKNVGPFLAVDQKHNILLKYRCHGPPIRFTTVFSNELHYVANELNGIVGGKNTVVAIAVWSHFSTFPLEVYIRRLRNIRRAVVRLLDRSPKTVVVIRTANAQELGPEVSLFNSDWYNFQLDTILRRMFSGVGVYLVDAWEMTLAHYLPHKLHPDEVIVKNQLDMFLSFVCPLET

SEQ ID NO: 1692 - protein, 130 aa, Homo sapiens
MALAVSRAAPTSVLTQGAGAPLRISPPHKPDLLGSPSRPPALGRCTQQGLLNSLRLRFPLSLLGYKQIPRGEKSRLTQPPAPLPWEATPRLPLEPTTGEHCLQSSLSLGKFRSHISLDPPRPGWTALVCL

SEQ ID NO: 1693 - protein, 563 aa, Homo sapiens
MEGPLTPPPLQGGGAAAVPEPGARQHPGHETAAQRYSARLLQAGYEPESMADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 1694 - protein, 782 aa, Homo sapiens
MSLRIDVDTNFPECVVDAGKVTLGTQQRQEMDPRLREKQNEIILRAVCALLNSGGGIIKAEIENKGYNYERHGVGLDVPPIFRSHLDKMQKENHFLIFVKSWNTEAGVPLATLCSNLYHRERTSTDVMDSQEALAFLKCRTQTPTNINVSNSLGPQAAQGSVQYEGNINVSAAALFDRKRLQYLEKLNLPESTHVEFVMFSTDVSHCVKDRLPKCVSAFANTEGGYVFFGVHDETCQVIGCEKEKIDLTSLRASIDGCIKKLPVHHFCTQRPEIKYVLNFLEVHDKGALRGYVCAIKVEKFCCAVFAKVPSSWQVKDNRVRQLPTREWTAWMMEADPDLSRCPEMVLQLSLSSATPRSKPVCIHKNSECLKEQQKRYFPVFSDRVVYTPESLYKELFSQHKGLRDLINTEMRPFSQGILIFSQSWAVDLGLQEKQGVICDALLISQNNTPILYTIFSKWDAGCKGYSMIVAYSLKQKLVNKGGYTGRLCITPLVCVLNSDRKAQSVYSSYLQIYPESYNFMTPQHMEALLQSLVIVLLGFKSFLSEELGSEVLNLLTNKQYELLSKNLRKTRELFVHGLPGSGKTILALRIMEKIRNVFHCEPANILYICENQPLKKLVSFSKKNICQPVTRKTFMKNNFEHIQHIIIDDAQNFRTEDGDWYGKAKFITQTARDGPGVLWIFLDYFQTYHLSCSGLPPPSDQYPREEINRVVRNAGPIANYLQQVMQEARQNPPPNLPPGSLVMLYEPKWAQGVPGNLEIIEDLNLEEILIYVANKCRFLLR

SEQ ID NO: 1695 - protein, 459 aa, Homo sapiens
MEGSASPPEKPRARPAAAVLCRGPVEPLVFLANFALVLQGPLTTQYLWHRFSADLGYNGTRQRGGCSNRSADPTMQEVETLTSHWTLYMNVGGFLVGLFSSTLLGAWSDSVGRRPLLVLASLGLLLQALVSVFVVQLQLHVGYFVLGRILCALLGDFGGLLAASFASVADVSSSRSRTFRMALLEASIGVAGMLASLLGGHWLRAQGYANPFWLALALLIAMTLYAAFCFGETLKEPKSTRLFTFRHHRSIVQLYVAPAPEKSRKHLALYSLAIFVVITVHFGAQDILTLYELSTPLCWDSKLIGYGSAAQHLPYLTSLLALKLLQYCLADAWVAEIGLAFNILGMVVFAFATITPLMFTGYGLLFLSLVITPVIRAKLSKLVRETEQGALFSAVACVNSLAMLTASGIFNSLYPATLNFMKGFPFLLGAGLLLIPAVLIGMLEKADPHLEFQQFPQSP

SEQ ID NO: 1696 - protein, 100 aa, Homo sapiens
MKGVHHRPHEAVPTWACGWGVATTEHMAVSRRKHFSSICLHAQGSSRLPVLSTGTAVSELLRTSLCQVVELGPSPYLSLVPTVLLTVQHLGALAWGWRPW

SEQ ID NO: 1697 - protein, 527 aa, Homo sapiens [sequence omitted]

SEQ ID NO: 1698 - protein, 102 aa, Homo sapiens
MHYHTGLIFVFLLETGFCHVAPAGLELLVSSDLPTSASQSAGITSVSHRARRTHTFLMSLALASQSVWITGVSFCAGQNRMLETHTEFTWKADCFPTPSLGG

SEQ ID NO: 1699 - protein, 372 aa, Homo sapiens [sequence omitted]

SEQ ID NO: 1700 - protein, 239 aa, Homo sapiens
MRTEAEAAGPPLEPGDFVQLPVPVIQQLYHWDCGLACSRMVLRYLGQLDDSEFERALQKLQLTRSIWTIDLAYLMHHFGVRHRFCTQTLGVDKGYKNQSFYRKHFDTEETRVNQLFAQAKACKVLVEKCTVSVKDIQAHLAQGHVAIVLVNSGVLHCDLCSSPVKYCCFTPSGHHCFCRTPDYQGHFIVLRGYNRATGCIFYNNPAYADRMCSTSISNFEEARTSYGTDEDILFVYLDS

SEQ ID NO: 1701 - protein, 176 aa, Homo sapiens
MLSLKLPQLLQVHQVPRVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLVSWSWKALGSVRSSAQEPSPIHSCSTTSHSFIGSGCAGAGATAVGRRP

SEQ ID NO: 1702 - protein, 447 aa, Homo sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYEVKMPACGMVTEAPAVGSRPRSPSSYDLVLHVPLTGAEACLMSVEEETELLLRSCHEGRCPLMLTECPACKGLVRLGEKERHLEHECPERSLSCRHCRAPCCGADVKAHHEVCPKFPLTCDGCGKKKIPREKFQDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 1703 - protein, 182 aa, Homo sapiens
MADSENQGPAEPSQAAAAAEAAAEEVMAEGGAQGGDCDSAAGDPDSAAGQMAEEPQTPAENAPKPKNDFIESLPNSVKCRVLALKKLQKRCDKIEAKFDKEFQALEKKYNDIYKPLLAKIQELTGEMEGCAWTLEGEEEEEEEYEDDEEEGEDEEEEEAAAEAAAGAKHDDAHAEMPDDAKK

SEQ ID NO: 1704 - protein, 180 aa, Homo sapiens
MAALDLRAELDSLVLQLLGDLEELEGKRTVLNARVEEGWLSLAKARYAMGAKSVGPLQYASHMEPQVCLHASEAQEGLQKFKVVRAGVHAPEEVGPREAGLRRRKGPTKTPEPESSEAPQDPLNWFGILVPHSLRQAQASFRDGLQLAADIASLQNRIDWGRSQLRGLQEKLKQLEPGAA

SEQ ID NO: 1705 - protein, 182 aa, Homo sapiens
MASAALHLTTLQLPHPSPGAPMTSPMSSSTLAHSLAAIEALADGPTSTSTCLEAQGGPSSPVQLPPASGAEEPDLQSLEAMMEVVVVQQFKCKMCQYRSSTKATLLRHMRERHFRPVAAAAAAAGKKGRLRKWSTSTKTQEEEGPEEEDDDDIVDAGAIDDLEGRPPWFLGLPSLCPSRHTH

SEQ ID NO: 1706 - protein, 110 aa, Homo sapiens
MRWPCPTSKPAPPPVLWSHLCQHRWGLTPASTLLCWLLLFNLGTCLSFSHLKQNNNNSNTSKISFDPASLCWVIISLSFPPFPSKHLKRVVYTQHSPFPHYPLTPQPAAI

SEQ ID NO: 1707 - protein, 539 aa, Homo sapiens
MSLSDKQTASLTAAYGQLSKGKPAECRMDSPKEISQAGFEWQRTEGKLNEIGLNVSMDGQPKDGLVKNASFLEQNKLCFFEGKLDKELSIEMQDKDCQEASGHLESRYVISETCHPLEGNSVHQKTSEFHLGLIEGPDKNKTIPVQGKVAGKNGLETKSQSDLDFPGAADIPTRYVKEQETSVWNPSFHPVAQGSLGSREATPGEMENSITPGCPVIGVVNDNSEQLKCESPLLVSLAHPAPIIEHSPTTIPPITMVFTQEHLNASCHIRDHDKELEKLSSTEEAVLNQAPQQKKAVRRALSECSHLSVPPAVNLADKYPELPAREEPSSGLLPPPSSPMPSPTPGKLGAPAMKRSMTVGEEQTASYKLSPGKLPILSTKEIPPFICEEPVAKKREELAHFSNSSSNSGKKELGTAGLYLHSKLEQIPEGSSKEKGQEDFSETRIDSCSQVCQRGEKQPGQTALAGKKEIEVTATQSTPSFLFEKPPRDGIARPEEGRPVVSGTGNDITTPPNKELPPSPEKKTKVGARMVVIFYCHNF

SEQ ID NO: 1708 - protein, 147 aa, Homo sapiens
MFLNGNCLETLKKKEPEGGRRRLSHPGNMGWMRPSQETTPPDRSHHSGFGLFCGDPGPEIEPFSLWVFPQEMVLEIHQLFMDHEYPCHHITSHCTWVAAHWTTSQSCAAWQGCRRACCSTWWKSPAQCTRPTVMSATFETAQEPGPS

SEQ ID NO: 1709 - protein, 102 aa, Homo sapiens
MVHLCGHCPSQPASSHCSFPSPCPALIGEVAARDQEATLPIVYYKQGEKSGEGKVPEENLISSCPSQSTEHPLHMLAKRPLIFPIRTMIVSKYIWVTGFGTQ

SEQ ID NO: 1710 - protein, 248 aa, Homo sapiens
MDQRQRRILGQPLSIPTSQPKQKRTSMISFFSKVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDIALQTRTLLDDENDSLRYSAFVLFGQLAAFAGRKWKKFFTSQVKQTRDSLLIHLQDRNPQVAKACKTTFQACSPYLKLKEEYSFQSEEDQRNTKLYQQLSHYHPEILQFFYANKIL

SEQ ID NO: 1711 - protein, 542 aa, Homo sapiens
MTPSLSAEENRMYNKMWHQTQEALGALLDKEPQKMIEPQRNQVFIFQTLATFYVKYVQIFRNLENVYDQFVHPQKRILIRKVLDGVMGRILELKNEMVELELTEFHYFDDILQDLKLAPQQLDIPIPKYFLKEKLEVIKGREKILAQILADSGIDTSDMKYPVKSIPFDEAVKLIQIAERARQGRLRALFMKQIYLQEYRAKQSKILGKKVTDTWAAALRIQKVWRRFHQRKETEKLREEEMIFLGMNPPPLFNEVGATVIQAEKVDRLRNEVQIKHEEDYREALVTIKNDLKLIEGVDIKENLQDQIRHWFIECRNLTGTFPDYPDVEEGGSAIIFSDKTIQQVIEDIIANQEEEEKNKKKKKKKEKQPKKAKKQKKGTKEKNKEEDEKWKMSPSLFLPAMKEGCNAYKEIWMKKDESWNFSQDYDPELIKEEKRKELQSEIRIQVDELMRQELKNLKLAVDRERERPVKAGKKKDKKKGKKGKKKEKKAKKDKDLTADRTIESLYKELVEEGLLIQALKVNLTLDTLHSLSKLDSSSHQY

SEQ ID NO: 1712 - protein, 530 aa, Homo sapiens [sequence omitted]

SEQ ID NO: 1713 - protein, 384 aa, Homo sapiens
MTRSLASPAGLQDGSAQHHPKGGSTSALKENATGHVESMAWTTPDPTSPDEACPDGRKENGCLSGHDLESIRPAGLHNSARGEVLGLSSSLGKELVFLQEELDLSEIHIPEAQEVEMASGHFAFLHVPVPDGRAPYCKASLSASSSLEPTPPEDTAISSLRPPSAPEMLTQHGAQEQVEDHPGHSSQAPIPRADPLPRRTRRPLLLPRLDPGQRGNKLPTGEQGLDEDVDGVCESHAAPGLECSSGSANCQGAGPSADGISSRLTPAESCMGLVRMNLYTHCVKGLMLSLLAEEPLLGDSAAIEEVKCLHGCVRLLQPHPGDIFPAAGTCSTELRLPKPSGWRLQPLRQSKAEAAEARGELALNCTQEVTGKEKTSKGSSAFYN

SEQ ID NO: 1714 - protein, 100 aa, Homo sapiens [sequence omitted]

SEQ ID NO: 1715 - protein, 175 aa, Homo sapiens [sequence omitted]

SEQ ID NO: 1716 - protein, 104 aa, Homo sapiens
MHAICPRDDSDCSLVSSTESQLLSDLSATSSRELVDSFRSSSPAPPSQQSLYKRVAEDFGEEPWSFSSCLEIPEGDPGALPGAKAGDPHLDYELLDTAGEHAQP

SEQ ID NO: 1717 - protein, 189 aa, Homo sapiens
MQKIVQTDEITNTQAFRKGKRKRTETMDSENANSDMDKGQRDPYSGNAFLPGESSSEDEEPLAELSKEELCAKIKSLKEKLTNTRKENSRLRQSLVMLQVLPQAVTQFEELVGMAEALLKGGGTMSTSASTLWRATNNSSPDSFASTCSNSNSNSSSPVSLKPEEEHQTDEKQFQIEKWQNPLLQGTKL

SEQ ID NO: 1718 - protein, 100 aa, Homo sapiens
MVWWDLLCRAWKTALLEANSTPVRVYSPYQDYYEVVPPNAHEATYVRSYYGPPYAGPGVTHVIVREDPCYSAGAPLAMGMLAGAATGAALGSLMWSPCWF

SEQ ID NO: 1719 - protein, 453 aa, Homo sapiens [sequence omitted]

SEQ ID NO: 1720 - protein, 138 aa, Homo sapiens
MKKEANLQRGGMGFRKFSPFLALSILVLYQAGSLQAAPFRSALEGSPDPATLSKEDARLLLAALVQDYVQMKASELKQEQETQGSSSAAQKRACNTATCVTHRLAGLLSRSGGMVKSNFVPTNVGSKAFGRRRRDLQA

SEQ ID NO: 1721 - protein, 404 aa, Homo sapiens
MALPKDAILSLSECQCGICMEILVEPVTLPCNHTLCKPCFQSTVEKASLCCPFCRRRVSSWTRYHTRRNSLVNVELWTIIQKHYPRECKLRASGQESEEVADDYQPVRLLSKPGELRREYEEEISKVAAERRASEEEENKASEEYIQRLLAEEEEEEKRQAEKRRRAMEEQLKSDEELARKLSIDINNFCEGSISASPLNSRKSDPVTPKSEKKSKNKQRNTGDIQKYLTPKSQFGSASHSEAVQEVRKDSVSKDIDSSDRKSPTGQDTEIEDMPTLSPQISLGVGEQGADSSIESPMPWLCACGAEWYHEGNVKTRPSNHGKELCVLSHERPKTRVPYSKETAVMPCGRTESGCAPTSGVTQTNGNNTGETENEESCLLISKEISKRKNQESSFEAVKDQCFS

SEQ ID NO: 1722 - protein, 102 aa, Homo sapiens [sequence omitted]

SEQ ID NO: 1723 - protein, 221 aa, Homo sapiens [sequence omitted]

SEQ ID NO: 1724 - protein, 103 aa, Homo sapiens
MQGAACDTWPALSQLPPLPFLSCLPCPQKERRGLTYHLCHSTWSQNPKSFPRPHCLAPQGPLSWVLCCAFPCLPPAASVTADPRPNGKPSAQLLLHWNKLLFL

SEQ ID NO: 1725 - protein, 107 aa, Homo sapiens
MFSYLILCPSRGSSLICLAWPCVPPVPCSTAYLVPQVLLATPAVTLNSFNSALNAPASEACPISFFLASVFFFSVFFPCFCRRLRGESFLWLPLLRLELEENLIFCI

SEQ ID NO: 1726 - protein, 163 aa, Homo sapiens [sequence omitted]

SEQ ID NO: 1727 - protein, 120 aa, Homo sapiens
MGNITVDSSSGCLKASTNQGAIDVYVSQLGKVELKSHKGSIIVKVPSSLQAHLQLSGKEVDVNSEVHVQEMAEVCKDDVVTVTGLMNQASKREKWIKADAPKGTVSFRRQSWFQSLKLQD

SEQ ID NO: 1728 - protein, 131 aa, Homo sapiens
MKAAGSLSEWLVHRLISEWPPAYEEKAATWHASLPSLAFLSKSQVTLHCAPWSLSRWRREGRPEMSFAGMWRNTIYMKSPLLALLIFSLPWPWRERLCHSKTVWGHGGCRPDLIFMQILFWEQWFIQTPVA

SEQ ID NO: 1729 - protein, 123 aa, Homo sapiens
MLQDYCEQVKVLSSKKRLNEYSILHFLPCLLLLSFLSSLSPFLFSSFALCLVPNIKNRKELISLPSPLQTSHYTACFLLISCLLSLNRQYQPSRSNNLSRCQGPGSVIKVGEFRKQHTSLSES

SEQ ID NO: 1730 - protein, 207 aa, Homo sapiens
MAAAPSASQASRSFVSCRHGDGAPVPHPAGATRVSCVPTTGAKPFPLCGLMWPRLGLVTQDPHHVTPANRDSSRRRRPLLHSEGRGVHPKSPERRCREEKLSASASLQGPALPFNSWRHHCARLSTPASLRNKTSSPGRGEVWAPGLASAGTRLKKRQDKLRLVSSNTHHSQPGDPHPSGPCVGTDTVPAGNHLCRFPHTRQPELCG

SEQ ID NO: 1731 - protein, 123 aa, Homo sapiens [sequence omitted]

SEQ ID NO: 1732 - protein, 151 aa, Homo sapiens
MICEASFPPLSCRCFILFSSFGPKEADEESWSERDPGSHSNFPLTCCETLASSLACLSLSFPPCKMDIKISAPLSCSSINVILYTACLVPAPVQMLRKYRPYLGALLSMKTGPLAKEKYFVISACSCPCPHEQVSSLSPPALLRTRFLIQI

SEQ ID NO: 1733 - protein, 152 aa, Homo sapiens
MSLPQFTSLPLSSPPLDAPDLSRLPPLHSCPSLLRSPVPSPPTCSPPPFLQPLLTSPPSRSPLPSPAKAIPPSHPRPPYVTSVGSMSLSSHPLLLPCPESHPGFLSSLPLLLCFLPLPSLPLLCLLLSSPPSLSAPAQFPPSPLHAPFLPSS

SEQ ID NO: 1734 - protein, 305 aa, Homo sapiens
MLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASVRRRAGGEGERDQRECSQYRLHPTDPRAPVSPGAPQASRGREQQPGFREAAGALHSAAAVPAGPRLRGHREQRPAGAV

SEQ ID NO: 1735 - protein, 311 aa, Homo sapiens [sequence omitted]

SEQ ID NO: 1736 - protein, 110 aa, Homo sapiens
MCFSFPFPLCWCPLALTPISCCRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 1737 - protein, 168 aa, Homo sapiens [sequence omitted]

SEQ ID NO: 1738 - protein, 114 aa, Homo sapiens [sequence omitted]

SEQ ID NO: 1739 - protein, 127 aa, Homo sapiens
MPSCDPGPGPACLPTKTFRSYLPRCHRTYSCVHCRAHLAKHDELISKSFQGSHGRAYLFNSVVNVGCGPAEQRLLLTGLHSVADIFCESCKTTLGWKYEQAFETSQKYKEGKYIIEMSHMVKDNGWD

SEQ ID NO: 1740 - protein, 157 aa, Homo sapiens [sequence omitted]

SEQ ID NO: 1741 - protein, 156 aa, Homo sapiens [sequence omitted]

SEQ ID NO: 1742 - protein, 618 aa, Homo sapiens
MGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQIRRILKGKSIQQRAPPY

SEQ ID NO: 1743 - protein, 168 aa, Homo sapiens [sequence omitted]

SEQ ID NO: 1744 - protein, 128 aa, Homo sapiens [sequence omitted]

SEQ ID NO: 1745 - protein, 126 aa, Homo sapiens [sequence omitted]

SEQ ID NO: 1746 - protein, 326 aa, Homo sapiens
MKHFLRMLIQVCLYFYCKFLWRCLKFVMRKLTGRCELQRICYNTKPGASRTMKIETSLRDSKSKLLQTSVSVHPDAIEKTIEDIMELKKINPDVNPQLGISLQACLLQIVGYRNLIADVEKLRREAYDSDNPQHEEMLLKLWKFLKPNTPLESRISKQWCEIGFQGDDPKTDFRGMGLLGLYNLQYFAERDATAAQQVLSDSLHPKCSKFSKAEWEKKRMDKAIGYSFAIVGINITDLAYNLLVSGALKTHFYNIAPEAPTLSHFQQTFCYLMHEFHKFWIEEDPMDIMEFNRVREKFRKRIIKQLQNPDMALCPHFAASEGLINM

SEQ ID NO: 1747 - protein, 255 aa, Homo sapiens [sequence omitted]

SEQ ID NO: 1748 - protein, 297 aa, Homo sapiens
MAGYATTPSPMQTLQEEAVCAICLDYFKDPVSISCGHNFCRGCVTQLWSKEDEEDQNEEEDEWEEEEDEEAVGAMDGWDGSIREVLYRGNADEELFQDQDDDELWLGDSGITNWDNVDYMWDEEEEEEEEDQDYYLGGLRPDLRIDVYREEEILEAYDEDEDEELYPDIHPPPSLPLPGQFTCPQCRKSFTRRSFRPNLQLANMVQIIRQMCPTPYRGNRSNDQGMCFKHQEALKLFCEVDKEAICVVCRESRSHKQHSVLPLEEVVQEYQEIKLETTLVGILQIEQESIHSKAYNQ

SEQ ID NO: 1749 - protein, 216 aa, Homo sapiens [sequence omitted]

SEQ ID NO: 1750 - protein, 251 aa, Homo sapiens
MICPFRHYYLCSKFCTEIVPLIFRVRLVERGSPHSLPLMESGKILPGVKVIIAHTETKGPLGDSHLGEIWVSSPHNATGYYTVYGEEALHADHFSARLSFGDTQTIWARTGYLGFLRRTELTDASGGRHDALYVVGSLDETLELRGMRYHPIDIETSVIRAHRSIAECAVFTWTNLLVVVVELDGLEQDALDLVALVTNVVLEEHYLVVGVVVIVDPGVIPINSRGEKQRMHLRDGFLADQLDPIYVAYNM

SEQ ID NO: 1751 - protein, 336 aa, Homo sapiens
MYTVLTGTPPFMASPLSEMYQNIREGHYPEPAHLSANARRLIVHLLAPNPAERPSLDHLLQDDFFTQGFTPDRLPAHSCHSPPIFAIPPPLGRIFRKVGQRLLTQCRPPCPFTPKEASGPGEGGPDPDSMEWDGESSLSAKEVPCLEGPIHLVAQGTLQSDLAGPEGSRRPEVEAALRHLQLCLDVGPPATQDPLGEQQPILWAPKWVDYSSKYGFGYQLLDGGRTGRHPHGPATPRREGTLPTPVPPAGPGLCLLRFLASEHALLLLFSNGMVQVSFSGVPAQLVLSGEGEGLQLTLWEQGSPGTSYSLDVPQSHGCAPTTGQHLHHALRMLQSI

SEQ ID NO: 1752 - protein, 116 aa, Homo sapiens
MFSVVCHFVSSLRGYFPASLKSSFPACCFWTLFSTVVTSCRLCGPILHQNVTSINSAAMRQIHQWPADSRQQAPMSDGHLHASRGPPPPCGVSRAGLTIPLGTRASGWPESSHTLC

SEQ ID NO: 1753 - protein, 226 aa, Homo sapiens
MIQAIQVLRFHLLELEKGKMPIDLVIEDRDGGCREDFEDYPASCPSLPDQNNIWIRDHEDSGSVHLGTPGPSSGGLASQSGDNSSDQGVGLDTSVASPSSGGEDEDLDQEPRRNKKRGIFPKVATNIMRAWLFQHLSHPYPSEEQKKQLAQDTGLTILQVNNWFINARRRIVQPMIDQSNRTGQGAAFSPEGQPIGGYTETEPHVAFRAPASVGMSLNSEGEWHYL

SEQ ID NO: 1754 - protein, 108 aa, Homo sapiens
MHTPEVASPSPGDRCREKSSPRPQTRFPSWHRVGDGWRVSIGTARSGCCQVGPCQGSSPPVHPVPGCPCTQIQQHGLYPAEWWHHHGYSGCPETLLGKRGRAEWEAGP

SEQ ID NO: 1755 - protein, 354 aa, Homo sapiens
MIGCSFVVDREYFGDIGLLDPGMEVYGGENVELGMRETEGFQQDKVNYKQNKRGRKTRQRVKRSRSEAHRAQPSPGATHGAHSRAPGPRTEPTAEPWGHARPTAALPATGVWQCGGSMEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTLTYGEVRNSKASAYCLDQGAEDGDRAILYPCHGMSSQLVRYSADGLLQLGPLGSTAFLPDSKCLVDDGTGRMPTLKKCEDVARPTQRLWDFTQSGPIVSRATGRCLEVEMSKDANFGLRLVVQRCSGQKWMIRNWIKHARH

SEQ ID NO: 1756 - protein, 285 aa, Homo sapiens
MAAASEPVDSGALWGLERPEPPPTRFHRVHGANIRVDPSGTRATRVESFAHGVCFSREPLAPGQVFLVEIEEKELGWCGHLRLGLTALDPASLAPVPEFSLPDLVNLGHTWVFAITRHHNRVPREGRPEAEAAAPSRPPTLLVEPYLRIEQFRIPRDRLVGRSRPGLYSHLLDQLYELNVLPPTARRSRLGVLFCPRPDGTADMHIIINGEDMGPSARGLPAAQPLYAVVDVFASTKSVRLVQLEYGLPSLQTLCRLVIQRSMVHRLAIDGLHLPKELKDFCKYE

SEQ ID NO: 1757 - protein, 106 aa, Homo sapiens
MSVSVRVRASVHERDCECACVEARRGAWLKACCLHGCQRKTEVGACCGLREDLMGALARAGHRAENNIAKNIWMDGGGRQIVRSNSDSPEEDGAEPEEAQGGGRQI

SEQ ID NO: 1758 - protein, 101 aa, Homo sapiens
MWSSAIKSMWEQSPSTEIWALLIHLSSRTTCFHNWQPCPTSRLCLKLPVLSGPTEATQDCRLKMGTVASTTWGSPHQPPHSQPSSLGFAKHQARLSSLRAM

SEQ ID NO: 1759 - protein, 215 aa, Homo sapiens
MFLMVMPGMISRILYPDEVACVVPEVCRRVCGTEVGCSNIAYPRLVVKLMPNGKGSPGPQAQARCGARCWEGSSLAQLQPPWTPSGPSLTAAVGPQVCADSCWRSCWPRSCPRWPPSSTAAARSSPWTSTRACGHAPATASCCWWDGAAWAPLLPNGSARGGGLRTCRGAQGPGSIRRPPPQALGGVHRGSVGGLASRGAGGTGRAALRLHPGSL

SEQ ID NO: 1760 - protein, 316 aa, Homo sapiens
MLVTLGLLTSFFSFLYMVAPSIRKFFAGGVCRTNVQLPGKVVVITGANTGIGKETARELASRGARVYIACRDVLKGESAASEIRVDTKNSQVLVRKLDLSDTKSIRAFAEGFLAEEKQLHILINNAGVMMCPYSKTADGFETHLGVNHLGHFLLTYLLLERLKVSAPARVVNVSSVAHHIGKIPFHDLQSEKRYSRGFAYCHSKLANVLFTRELAKRLQGTGVTTYAVHPGVVRSELVRHSSLLCLLWRLFSPFVKTAREGAQTSLHCALAEGLEPLSGKYFSDCKRTWVSPRARNNKTAERLWNVSCELLGIRWE

SEQ ID NO: 1761 - protein, 177 aa, Homo sapiens
MQARQMFEGEVASLEALRSTGLVRVPRPMKVIDLPGGGAAFVMEHLKMKSLSSQASKLGEQMADLHLYNQKLREKLKEEENTVGRRGEGAEPQYVDKFGFHTVTCCGFIPQVNEWQDDWPTFFARHRLQAQLDLIEKDYADREARELWSRLQVGTAVTSLGKSWSSHDPAAFVRVHL

SEQ ID NO: 1762 - protein, 200 aa, Homo sapiens
MTSAETASRAAESGGTPVRPCSRPHRAPSPAAPSRPGAPAAGPRKLLVPGLPCLVRGGWPWTRPDSSPFRPAARPRMSPHRSPAVARRCGRPRRRDPRRRRTPALPRPWPGRGGPGRSLLHRHLFIQQLLRTCWPALPRDRTPAPGGTMPGAALAGPGRQASGSPAPQSEGAPPRPWTPLQPGLHHRPPSSSSGLLSSFF

SEQ ID NO: 1763 - protein, 136 aa, Homo sapiens [sequence omitted]

SEQ ID NO: 1764 - protein, 202 aa, Homo sapiens
MKVKVIPVLEDNYMYLVIEELTREAVAVDVAVPKRLLEIVGREGVSLTAVLTTHHHWDHARGNPELARLRPGLAVLGADERIFSLTRRLAHGEELRFGAIHVRCLLTPGHTAGHMSYFLWEDDCPDPPALFSGTRSAERAHPASRRPRPICSDPPSPARRRAVGGRLRLVPGGQRPADVPEPGRAGYPAPRDEGVLRPRAHA

SEQ ID NO: 1765 - protein, 463 aa, Homo sapiens
MSGGEQKPERYYVGVDVGTGSVRAALVDQSGVLLAFADQPIKNWEPQFNHHEQSSEDIWAACCVVTKNLREICWDKAGHFFDLPDFLSWKATGVTARSLCSLVCKWTYSAEKGWDDSFWKMIGLEDFVADNYSKIGNQVLPPGASLGNGLTPEAARDLGLLPGIAVAASLIDAHAGGLGVIGADVRGHGLICEGQPVTSRLAVICGTSSCHMGISKDPIFVPGVWGPYFSAMVPGFWLNEGGQSVTGKLIDHMVQGHAAFPELQVKATARCQSIYAYLNSHLDLIKKAQPVGFLTVDLHVWPDFHGNRSPLADLTLKGMVTGLKLSQDLDDLAILYLATVQAIALGTRFIIEAMEAAGHSISTLFLCGGLSKNPLFVQMHADITGMPVVLSQEVESVLVGAAVLGACASGDFASVQEAMAKMSKVGKVVFPRLQDKKYYDKKYQVFLKLVEHQKEYLAIMNDD

SEQ ID NO: 1766 - protein, 133 aa, Homo sapiens [sequence omitted]

SEQ ID NO: 1767 - protein, 169 aa, Homo sapiens
MDLQRPDSYQGGAGPDFNDHVLHKTILVGDSGVGKTSLLVQFDQGKFIPGSFSATVGIGFTNKVVTVDGVRVKLQIWDTAGQERFRSVTHAYYRDAQALLLLYDITNKSSFDNIRAWLTEIHEYAQRDVVIMLLGNKVSGSGAGSAQPCTSSALAGPITTQEQLSRHPS

SEQ ID NO: 1768 - protein, 269 aa, Homo sapiens
MDEIEKCQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKKRRRGRKEGEEDQNPPCPRLSSVLMEVEVPEVLQDSLDRYYSTPSMYFELPDSFQHYRSVFYSFEEQHISFALDMDNRFFTLTVRSLHLVFQMGVIFPQ

SEQ ID NO: 1769 - protein, 140 aa, Homo sapiens
MGGGSRGPAPTPSCLTLLSCPHPCAFVPETRVATQAGPGSSLILPLPSEPCSSLPSPLPPLPRRVTSDRAPLAIQGGSRGLDRRARRLPAVAGASCPCRVGELSGREPYLPSAKTVKVYRLFTDFYLNCKSADFVNVLGV

SEQ ID NO: 1770 - protein, 469 aa, Homo sapiens
MNQASPARKLEEILHLAELCIEVLQQNEEHHAEGREAFAWWPDLLAEHAEKFWALFTVDMDTALEAQPQDSWDSFPLFQLLNNFLRNDTLLCNGKFHKHLQEIFVPLVVRYVDLMESSIAQSIHRGFEQETWQPVKNIANSLPNVALPKVPSLPLNLPQIPNISTASWMPSLYESTNGSATSEDLFWKLDALQMFVFDLHWPEQEFAHHLEQRLKLMASDMLEACVKRTRTAFELKLQKASKTTDLRIPASVCTMFNVLVDAKKQSTKLCALDGGQEQQYHSKIDDLIDNSVKEIISLLVSKFVSVLEGVLSKLSRYDEGTFFSSILSFTVKAAAKYVDVPKPGMDLADTYIMFVRQNQDILREKVNEEMYIEKLFDQWYSSSMKVICVWLTDRLDLQLHIYQLKTLIKIVKKTYRDFRLQGVLEGTLNSKTYDTVHRRLTVEEATASVSEGGGLQGITMKDSDEEEEG

SEQ ID NO: 1771 - protein, 133 aa, Homo sapiens
MRGEHNSTSYDSAVIYRGFWAVLMLLGVVAVVIASFLIICAAPFASHFLYKAGGGSYIAAGILFSLVVMLYVIWVQAVADMESYRNMKMKDCLDFTPSVLYGWSFFLAPAGIFFSLLAGLLFLVVGRHIQIHH

SEQ ID NO: 1772 - protein, 783 aa, Homo sapiens
MLDQHHTDLILKLHAAVTKIQVPRPGFNYTFAHICILNNDKTCIVDDIVHVLEELKNARATNRTNFAITYPITHLKDGRAVYNGHQLGGVTVHSKDRVKSAEAIQLTYYLQSINSLNDMVAERWESSFCDTVRLFQKSNSKVKMYPYTSSSLREDFQKTSRVSERYLVTSLILVVTMAILCCSMQDCVRSKPWLGLLGLVTISLATLTAAGIINLTGGKYNSTFLGVPFVMLGHGLYGTFEMLSSWRKTREDQHVKERTAAVYADSMLSFSLTTAMYLVTFGIGASPFTNIEAARIFCCNSCIAIFFNYLYVLSFYGSSLVFTGYIENNYQHSIFCRKVPKPEALQEKPAWYRFLLTARFSEDTAEGEEANTYESHLLVCFLKRYYCDWITNTYVKPFVVLFYLIYISFALMGYLQVSEGSDLSNIVATATQTIEYTTAQQKYFSNYSPVIGFYIYESIEYWNTSVQEDVLEYTKGFVRISRFESYLNYLRKLNVSTGLPKKNFTDMLRNSFLKAPQFSHFQEDIIFSKKYNDEVDVVASRMFLVAKTMETNREELYDLLETLRRLSVTSKVKFIVFNPSFVYMDRYASSLGAPLHNSCISALFLLFFSAFLVADSLINVWITLTVVSVEFGVIGFMTLWKVELDCISVLCLIYGINYTIDNCAPMLSAFVLGKDFTRTKWVKNALEVHGVAILQSYLCYIVGLIPLAAVPSNLTCTLFRCLFLIAFVTFFHCFAILPVILTFLPPSKKKRKEKKNPENREEIECVEMVDIDSTRVVDQITTV

SEQ ID NO: 1773 - protein, 209 aa, Homo sapiens [sequence omitted]

SEQ ID NO: 1774 - protein, 109 aa, Homo sapiens
MDKPCGCPPGVCDHGTGDRRDPWYSTVGLLPPVRAMSQRNLNAKTEQGPTGVTMTSNPITWGQIKKTTQEAEKLLERQGQAKTPDSMFLAMLAVVSCASIGSGEPPTGN

SEQ ID NO: 1775 - protein, 134 aa, Homo sapiens
MGKAWTRVGVPPARSAGKMNFPASSLRRQNIPHVYWWHLKTAGQPENMDCVPPGEFLAGCPGAEARPKRLFQEKKWPSVSKDAKLTSEFLAGLAIKEDVADLSTSNVRERGRWKWTRTSEWKVTNGSKETYPDH

SEQ ID NO: 1776 - protein, 311 aa, Homo sapiens
MPDGSVLLVDNVCHQSGEVSMGSFCRLPGTSGCFPCPLNALEEHNFLFQLRGGEQPPPGAKEGLEVPLIAVVQWSTPKLPFTQSIYTHYRLPSVRLDRPCFVMTASCKSPVRTYERFTVTYTLLNNLQDFLAVRLVWTPEHAQAGKQLCEEERRAMQAALDSVVCHTPLNNLGFSRKGSALTFSVAFQALRTGLFELSQHMKLKLQFTASVSHPPPEARPLSRKSSPSSPAVRDLVERHQASLGRSQSFSHQQPSRSHLMRSGSVMERRAITPPVASPVGRPLYLPPDKAVLSLDKIAKRECKVLVVEPVK

SEQ ID NO: 1777 - protein, 127 aa, Homo sapiens [sequence omitted]

SEQ ID NO: 1778 - protein, 134 aa, Homo sapiens
MQTLATGHLAHEGSSPHKLSGGRTQESSGFSEAKGGHGAPRHSASHGATPSGLRRGLHCREGPSDSGFQPHPGPPLSVPSGPLAPRARRHPNPLGMSVLRMWHTRPGRAILLLLHPPQPWIRGLYRGQKFTQSR

SEQ ID NO: 1779 - protein, 175 aa, Homo sapiens
MWKPSPSSSPASWSCTALRAPQSCLRAATVRPVTLQARADSPTVPEPVHRPQDPWHIPGVPEPVHRPQDPWPWLQLVPPAELAYCLLMLLLAHCMKQQARPGHPDFLHREAWACLSAAGGLASPGLLLWATARPRASGEAGPGRALVGADAACCPRHSVLSLVDIPSGQVLPQGQ

SEQ ID NO: 1780 - protein, 106 aa, Homo sapiens
MNRGGGACHEQRSCYCTPAWVTERDSISKKKKKKKKKESDAQSGRQTIHISFIGTTVKDDTGEEPSWIYKELHMRWHTYSCCLKIQSRYHIKLKMSPLSGELDMFY

SEQ ID NO: 1781 - protein, 173 aa, Homo sapiens [sequence omitted]

SEQ ID NO: 1782 - protein, 381 aa, Homo sapiens
MTVPKEMPEKWARAQAPPSWSRKKPSWGTEEERRARANDREYNEKFQYASNCIKTSKYNILTFLPVNLFEQFQEVANTYFLFLLILQLIPQISSLSWFTTIVPLVLVLTITAVKDATDDYFRHKSDNQVNNRQSQVLINGILQQEQWMNVCVGDIIKLENNQFVAADLLLLSSSEPHGLCYIETAELDGETNMKVRQAIPVTSELGDISKLAKFDGEVICEPPNNKLDKFSGTLYWKENKFPLSNQNMLLRGCVLRNTEWCFGLVIFAGPDTKLMQNSGRTKFKRTSIDRLMNTLVLWIFGFLVCMGVILAIGNAIWEHEVGMRFQVYLPWDEAVDSAFFSGFLSFWSYIIILNTVVPISLYVSPECGGHPSGPQLLHQLG

SEQ ID NO: 1783 - protein, 180 aa, Homo sapiens
MEISEVDEGFYSRAASSTSQSGLSNSSHNCSNKPSIGKNHRRSGGSKTGGKEKETTGESCKDHFARKQTQRAQSENLELLSLKRLTLTTSQSLPKPSSHGLAKTAATVFSKSFEQVSGVTVPHNPSSAVGCGAGTDANRFSACSLQEEKLIYVSERTELPMKHQSGQQRPPSISITLSTD

SEQ ID NO: 1784 - protein, 560 aa, Homo sapiens
MAAARLLPVPAGPQPLSFQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWECETKGESQNTDLSPKPLISEQTVILGKTPLGRIDQENNETKQSFCLSPNSVDHREVQVLSQSMPLTPHQAVPSGERPYMCVECGKCFGRSSHLLQHQRIHTGEKPYVCSVCGKAFSQSSVLSKHRRIHTGEKPYECNECGKAFRVSSDLAQHHKIHTGEKPHECLECRKAFTQLSHLIQHQRIHTGERPYVCPLCGKAFNHSTALRSHQRVHTGEKPHRCNECGKTFSVKRTLLQHQRIHTGEKPYTCSECGKAFSDRSVLIQHHNVHTGEKPYECSECGKTFSHRSTLMNHERIHTEEKPYACYECGKAFVQHSHLIQHQRVHTGEKPYVCGECGHAFSARRSLIQHERIHTGEKPFQCTECGKAFSLKATLIVHLRTHTGEKPYECNSCGKAFSQYSVLIQHQRIHTGEKPYECGECGRAFNQHGHLIQHQKVHRKL

SEQ ID NO: 1785 - protein, 103 aa, Homo sapiens [sequence omitted]

SEQ ID NO: 1786 - protein, 230 aa, Homo sapiens
MDMGTSALSKKPWWTLPQNFHAPMVFHMEEDQEELIFGHGDTYLRCIEVHSHTLIQLESWFTATGQTRVTVVGPHRARQWLLHMFCCVGSQDSYHHARGGSTAWPWERVLSARSRGGPCPKTFILQWCSTWKRTRRSSSSDLMTRTFAALSCTATPLFSWRCFTATGQTRVTVVGPPMAKQWLLLMFHCVGSQDSKCHARGLKMLERVRSQPLTNDDLVTSVSLPPYTGD

SEQ ID NO: 1787 - protein, 105 aa, Homo sapiens
MTECAPGLGIRDGVTKSLVDDGEVARGFADGQPCPAATPLGLFLVRSLNNLKSQQPEEILPPFSQVCSPSSWEPAPGAIPLQTESPECLGENWLNKRYKDFLYFS

SEQ ID NO: 1788 - protein, 111 aa, Homo sapiens
MAYVVSFPVISLTLSSPTFPFIHFIPATPISFLTLKHTRMLLFQGYSFHPEYCNFTLISLGVYLNVFHSVWPSLLKITAPTVKTSCSVFSKTCITICYTIQEMCHLLPPVE

SEQ ID NO: 1789 - protein, 384 aa, Homo sapiens
MFHSLDRNQDGHIDVSEIQQSFRALGISISLEQAEKILHSMDRDGTMTIDWQEWRDHFLLHSLENVEDVLYFWKHSTVLDIGECLTVPDEFSKQEKLTGMWWKQLVAGAVAGAVSRTGTAPLDRLKVFMQVHASKTNRLNILGGLRSMVLEGGIRSLWRGNGINVLKIAPESAIKFMAYEQIKRAILGQQETLHVQERFVAGSLAGATAQTIIYPMEVLKTRLTLRRTGQYKGLLDCARRILEREGPRAFYRGYLPNVLGIIPYAGIDLAVYETLKNWWLQQYSHDSADPGILVLLACGTISSTCGQIASYPLALVRTRMQAQASIEGGPQLSMLGLLRHILSQEGMRGLYRGIAPNFMKVIPAVSISYVVYENMKQALGVTSR

SEQ ID NO: 1790 - protein, 455 aa, Homo sapiens
MSINISVLHGKVSSKSFSCRETRVAQKLAEKLLIKAKANGKLNLEDGFLDFYSINRQGPYFDKSFPSDVAVKEDLPVGANILKIKAYDADSGFNGKVLFTISDGNTDSCFNIDMETGQLKVLMPMDREHTDLYLLNITIYDLGNPQKSSWRLLTINVEDANDNSPVFIQDSYSVNILESSGIGTEIIQVEARDKDLGSNGEVTYSVLTDTQQFAINSSTGIVYVADQLDRESKANYSLKIEARDKAESGQQLFSVVTLKVFLDDVNDCSPAFIPSSYSVKVLEDLPVGTVIAWLETHDPDLGLGGQVRYSLVNDYNGRFEIDKASGAIRLSKELDYEKQQFYNLTVRAKDKGRPVSLSSVSFVEVEVVDVNENLHTPYFPDFAVVGSVKENSRIGTSVLQVTARDEDSGRDGEIQYSIRDGSGLGRFSIDDESGKCNILCQECCFTSFKWSTVEK

SEQ ID NO: 1791 - protein, 101 aa, Homo sapiens
MSVQLLAKRRPWSGKLLFACRWSHCLCSSQQRGGPGVGSSSLLLVILMSAQLWLSAGVLWASEGGKCMPTGPWAGPEKAPQAPTLVCGAGSPTPAFRPSLA

SEQ ID NO: 1792 - protein, 181 aa, Homo sapiens [sequence omitted]

SEQ ID NO: 1793 - protein, 144 aa, Homo sapiens
MPDPSSEWLYRVTVATILYFSWFNVAEGRTRGRAIIHFAFLLSDSILLVATWVTHSSWLPSGIPLQLWLPVGCGCFFLGLALRLVYYHWLHPSCCWKPDPDQVDGARSLLSPEGYQLPQNRRMTHLAQKFFPKAKDEAASPVKG

SEQ ID NO: 1794 - protein, 149 aa, Homo sapiens
MVPDRSKRVCVFHVWFNISYIRYGNPKDYKSFYYKDTCTCMFIAALFTIAKTWNQSKCPSMIDWIKKMWHIYTMEYNAAIKKNVFMSFVGDIDEAGNHHPQQTNTGTENQTPCVLTRKWELNNENTWTHRGEHHTPGTFGSEGQGEGEH

SEQ ID NO: 1795 - protein, 219 aa, Homo sapiens [sequence omitted]

SEQ ID NO: 1796 - protein, 320 aa, Homo sapiens [sequence omitted]

SEQ ID NO: 1797 - protein, 113 aa, Homo sapiens
MEFPGHFSSSLVISCQVPHTRFPSTQLWSGPWKRNRNGLVLSTAPFPLSFSSPSLLFPPSTIHLCPSALSRVGDVEGESSHSTACLLVLGVSSNSSFFPNPYHLPPPPSGQTL

SEQ ID NO: 1798 - protein, 120 aa, Homo sapiens
MSSSSSEPPNGQEGGIQGSASTPSGTLASLGDTWWAGGLGPFPRSLKSCVPSCRTQDGSEFLLQAKDEEEMNGWLEAVASSVAEHAEIARWGQTLPTTSSTDEGNPKREGGDRRASGRRK

SEQ ID NO: 1799 - protein, 128 aa, Homo sapiens
MFSLVISVFLPLNEYFLFLSFFASQNYLATRGLTWKNMLTESLVALQRGVFLLSDYRVTGDTVLCYCCGLRSFRELTYQYRQNIPASELPVAVTSRPDCYWGRNCRTQVKAHHAMKFNHICEQTRFKN

SEQ ID NO: 1800 - protein, 244 aa, Homo sapiens
MNDPFARMETRGPQGAANPMDSSRSLGDLGPFPREVGRGAPLAPGARNPATAGASRSQGGGHEDRTADRALGPRAGEELDRESWVREKVLFLLHPERWLGTRGDPAREEVAGAEDLPHAGGEDHGEEPNYPSVFQREKRISGRRVAPPRDAADPPKYVLVRVEDYQVTQEVLQTSWAKGRMTTRTEEHFVTALTFRSSREGQPGERWGPAESRALQARTGASRVHAAGRRVSPSPGTWLEEIKL

SEQ ID NO: 1801 - protein, 116 aa, Homo sapiens [sequence omitted]

SEQ ID NO: 1802 - protein, 104 aa, Homo sapiens
MKVLSCSSKQPLHWVFMLQYYRLGMQPPLFFTVYNEVKFVLEGPEVFRIYSYLKTLLIISIWPKCFHVHTLPLFPSQRPLVFFFFFFWFFFWSSLHFLPAQKCR

SEQ ID NO: 1803 - protein, 101 aa, Homo sapiens
MIIHFQQHFLVCSLVSRKKMSLRSERRGIHVDPVQERMWLLWQPYLAGFLLQVLEGRVAQSQAEADSGVLGAGGTTPAGGRRGLCQQSEQPRGPIPHILQV

SEQ ID NO: 1804 - protein, 110 aa, Homo sapiens [sequence omitted]

SEQ ID NO: 1805 - protein, 125 aa, Homo sapiens [sequence omitted]

SEQ ID NO: 1806 - protein, 168 aa, Homo sapiens
MESVLSKYEDQITIFTDYLEEYPDTDELVWILGKQHLLKTEKSKLLSDISARLWFTYRRKFSPIGGTGPSSDAGWGCMLRCGQMMLAQALICRHLGRDWSWEKQKEQPKEYQRILQCFLDRKDCCYSIHQMEKMCRVLPLSADTAGDRPPDSLTASNQSKGTSAYCSA

SEQ ID NO: 1807 - protein, 249 aa, Homo sapiens [sequence omitted]

SEQ ID NO: 1808 - protein, 203 aa, Homo sapiens
MAGTKNKTRAQAKTEKKAAIQAKAGAEREATGVVRPVAKTRAKAKAKTGSKTDAVAEMKAVSKNKVVAETKEGALSEPKTLGKAMGDFTPKAGNESTSSTCKNEAGTDAWFWAGEEATINSWFWNGEEAGNSFSTKNDKPEIGAQVCAEELEPAAGADCKPRSGAEEEEEENVIGNWFWEGDDTSFDPNPKPVSRIVKPQPVY

SEQ ID NO: 1809 - protein, 192 aa, Homo sapiens
MQRGALSPVLMLSAAPEPPPRPPPALSPPGSGPGSGSRHGSARPGPTPEPSGSLGAALDSSLRAAVAFKAEGQRCYREKKFREAIGKYHRALLQLKAAQGARPSGLPAPAPGPTSSPGPARLSEEQRRLVESTEVECYDSLTGTPSGGGGMGHEGRGQSGELGDLGARGPGAEGSRAVGFSGSLQSLIKERD

SEQ ID NO: 1810 - protein, 167 aa, Homo sapiens [sequence omitted]

SEQ ID NO: 1811 - protein, 107 aa, Homo sapiens
MCLCFPGFGINWKERISEFSYLFCSITSPSYLWLETPTLVHPFLPHTSIMSLGLSLESLAAQAIGFQFSLRFPREITKFQRLVFKPRISMYPFPNAVWTCSRQSTQP

SEQ ID NO: 1812 - protein, 107 aa, Homo sapiens [sequence omitted]

SEQ ID NO: 1813 - protein, 149 aa, Homo sapiens
MMSFTCFSTFNFHRTLSPLQVGKLRHSAFFPPPLTRSWGTQGTRHPILPPSGAVFIDFHHTGASSRGSIQMSAPDLSTALRGVWDGSPGHVILSCIAEQPPSGCVCTAPVCMCDCASACVQVWASQAECLCVSVRRCGSEHVRMCPRVQ

SEQ ID NO: 1814 - protein, 376 aa, Homo sapiens
MEVPRLDHALNSPTSPCEEVIKNLSLEAIQLCDRDGNKSQDSGIAEMEELPVPHNIKISNITCDSFKISWEMDSKSKDRITHYFIDLNKKENKNSNKFKHKDVPTKLVAKAVPLPMTVRGHWFLSPRTEYTVAVQTASKQVDGDYVVSEWSEIIEFCTADYSKVHLTQLLEKAEVIAGRMLKFSVFYRNQHKEYFDYVREHHGNAMQPSVKDNSGSHGSPISGKLEGIFFSCSTEFNTGKPPQDSPYGRYRFEIAAEKLFNPNTNLYFGDFYCMYTAYHYVILVIAPVGSPGDEFCKQRLPQLNSKDNKFLTCTEEDGVLVYHHAQDVILEVIYTDPVDLSLGTVAEITGHQLMSLSTANAKKDPSCKTCNISVGR

SEQ ID NO: 1815 - protein, 287 aa, Homo sapiens [sequence omitted]

SEQ ID NO: 1816 - protein, 204 aa, Homo sapiens
MKPEFEKAAEALHGEADSSGVLAAVDATVNKALAERFHISEFPTLKYFKNGEKYAVPVLRTKKKFLEWMQNPEAPPPPEPTWEEQQTSVLHLVGDNFRETLKKKKHTLVMFYAPWCPHCKKVIPHFTATADAFKDDRKIACAAVDCVKDKNQDLCQQEAVKGYPTFHYYHYGKFAEKYDSDRTVSGGEASAQSSLSADGQGNFH

SEQ ID NO: 1817 - protein, 262 aa, Homo sapiens
MDFFFRFSAVVGVWQEFEGAEKEIGNVKREDSTCAKHIPRIGPRLGDAEWALRRALQPWEWTPAQAEGQGLAGWGLCACAELKGSVLQISTRAQLSGRGRGEQLRTIVFLTQTHPARWKPGWRAGLAFCPGSANPPIPGSSDDGINCLGYRLLSKEWLPLYTNLTVDITSKPQETQCKAEGYLIWKPERAPEAKVTGKPSHSPHLVSFKSRVYFISFLPSLIPSFHLSIHLLSPPSLPPFSFSSSPHLLLFSFFQLCPEGPS

SEQ ID NO: 1818 - protein, 127 aa, Homo sapiens [sequence omitted]

SEQ ID NO: 1819 - protein, 169 aa, Homo sapiens [sequence omitted]

SEQ ID NO: 1820 - protein, 137 aa, Homo sapiens
MGPGAPFARVGWPLPLLVVMAAGVAPVWASHSPHLPRPHSRVPPHPSLIFSAVSITEAASWAEMAVEALNLTSTIQAGSRRKGNGQRGCALQPIQPPFAAEEAGKCGIYWEHCCPSSKLRVLARRTKARKDRWISAS

SEQ ID NO: 1821 - protein, 103 aa, Homo sapiens
MPLEKFVDMEFLDQMILRGTCLEADLCPQYTNSPFNAHTDQITQTHLPPQHLDSSHSTHTCLPVHRHIQRHTDKHHSKKMFPRTHGHPNPRIIRLSQRHVCTA

SEQ ID NO: 1822 - protein, 148 aa, Homo sapiens [sequence omitted]

SEQ ID NO: 1823 - protein, 107 aa, Homo sapiens
MKGDGKSQMLQRSRETEGCRLQSWGHGQRQGRFITDGKSVADHVHRGGPEQRSDMRTQENSGPGSGTAVHPHPGRGWHLRRHSCPSLARSNLGTDGGRGRATRGGTF

SEQ ID NO: 1824 - protein, 169 aa, Homo sapiens
MCSSFRKKSCFCQNVLLSLLLALWAQEFHCCDSCRTKRERLSLAVKPFIHSPMYSFSKRLPAAYQERGEFCSRGTSPSFSLGKSATQAPIFQKTHLLLVSSSYEPLSRLSRPFITLISSPSSACPRPTQILLFHEVFPPDSMNFVVHLCSAITSRLPPTVALAIICLRS

SEQ ID NO: 1825 - protein, 160 aa, Homo sapiens [sequence omitted]

SEQ ID NO: 1826 - protein, 100 aa, Homo sapiens [sequence omitted]

SEQ ID NO: 1827 - protein, 173 aa, Homo sapiens
MPGARDALCHQALQLLAELCARGALEHDSCQDFIYHLRDRARPRLRDPDISVSLLTLVVTACGLALFGVSLFVSWKLCWVPWRERGLPSGSKDNNQEPLNYMDTETNEQENSEDFLDPPTPCPDSSMKISHTSPDIPLSTQTGIQENCAHGVRVQRQVTEPTSSARTTWIWES

SEQ ID NO: 1828 - protein, 599 aa, Homo sapiens [sequence omitted]

SEQ ID NO: 1829 - protein, 216 aa, Homo sapiens
MLIAKTMGKMSPRACQRSSWLPLQYRPGGLRGKNGFMGQSQSPAANCILGTWCPASQPLQLQLWLWLKGANVQLGPWLQRVQATSLGGFHMVLGLWVHKRQERRFGSLHLDFRGCMEMPGCPGRTPLQGQSPHGDPLLGQCRGGNVGLEPSQRVSTRALPNGAVGRGPSSSRPHKGGSTDSLHCVPAKVAGTQCQPIKAAVGAVSCRAMGQSCQRP

SEQ ID NO: 1830 - protein, 125 aa, Homo sapiens
MSQCQDFEQRTPSTRGQAFPRGNVGAKVEAERLRRALSLGSLCQTSLYYFWVCFRNVCSNPSCVLGGKEQGYIVLTYLWDLKIKTIEFMELKNRRRLPEAGKGSGVVGEGGGEVKMVNHYKKKKK

SEQ ID NO: 1831 - protein, 198 aa, Homo sapiens
MRDLVNRLPGGNGPSVLSDESMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSVGSTSSSPALLGIRDPRSEYDRTQPPMQYYNSQGDATHKGLYPGKTPVGCVIQSLEKPHFQALGQWPGK

SEQ ID NO: 1832 - protein, 119 aa, Homo sapiens [sequence omitted]

SEQ ID NO: 1833 - protein, 149 aa, Homo sapiens
MRPTGGSGQRGPRYTTSLLFHCLLPCSDHSSGAVSQAWASFNIFYLALHGAAPAMVPQGFFSQVSSLERSPRFPVKQPCSLCLSQPHHPVASFTACLTICNHLSVCRLVDLLPPHCQLLGNRDWFVYCASLVPRTGHGILLVHNKYCGN

SEQ ID NO: 1834 - protein, 107 aa, Homo sapiens
MIWPEATQPNLQDSWFSTWCLGSLFPLGLEKQDRELFFGLSSRERESLSRLLCSTLLLTGAFCPRLLCASIEPGAFHTPSHEPRKSYMKGERSLAHCAGKETKAQSS

SEQ ID NO: 1835 - protein, 100 aa, Homo sapiens
MGVGEKGDSRVLPFCEALGVECGHLRPYDGTTLSCLPFRKPNLQSTANQILHIPATVFLSPLNLSPWPCGQGGFLLSYPNFGNGRGERRAITTLPSRLIS

SEQ ID NO: 1836 - protein, 269 aa, Homo sapiens
MSSDHLNNSTLKEAQFKDLFLKKAELEFAQIIIIVVVVTVMVVVIVCLLNHYKVSTRSFINRPNQSRRREDGLPQEGCLWPSDSAAPRLGASEIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 1837 - protein, 350 aa, Homo sapiens
MTQSSPSPLQLPPEDAYVGNADMIQPDLTPLQPSLDDFMDISDFFTNSRLPQPPTPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPVRSRALGGGAVPTAFNPTLRPSPPQQETVPEFPCTFLPPTPAPTPPRPPPG

SEQ ID NO: 1838 - protein, 560 aa, Homo sapiens
MDRGSFCHQMSFCLTELHLWSLKNTLHIADRDIGIYQYYDKKDPPATEHGNLEKKQKLAESRDYPWTLKNRRPEKLRDSLKELEELMQNSRCVLSKWKNKYVCQLLFGSGVLVSLSLSGPQLEKVVIDRSLVGKLISDTISDALLTDSFIILSFLAQNKLCFIQFTKKVESSDANKRLEKLSALDYKIFYYEIPGPINKTTERHLAINCVHDRVVCWWPLVNDDAWPWAPISSEKDRANLLLLGYAQGRLEVLSSVRTEWDPLDVRFGTKQPYQVFTVEHSVSVDKEPMADSCIYECIRNKIQCVSVTRIPLKSKAISCCRNVTEDKLILGREDSSLILYETHRRVTLLAQTELLPSLISCHPSGAILLVGSNQGELQIFDMALSPINIQLLAEDRLPRETLQFSKLFDASSSLVQMQWIAPQVVSQKGEGSDIYDLLFLRFERGPLGVLLFKLGVFTRGQLGLIDIIFQYIHCDEIYEAINILSSMNWDTLGHQCFISMSAIVNHLLRQKLTPEREAQLETSLGTFYAPTRPLLDSTILEYRDQISKYARRFFHHLLSE

SEQ ID NO: 1839 - protein, 208 aa, Homo sapiens
MKLPSISCPHECFEAILSLDTGYRAPVTLVRKGCWTGPPAGQTQSNPDALPPDYSVVRGCTTDKCNAHLMTHDALPNLSQAPDPPTLSGAECYACIGVHQDDCAIGRSRRVQCHQDQTACFQGSGRMTVGNFSVPVYIRTCHRPSCTTEGTTSPWTAIDLQGSCCEGYLCNRKSMTQPFTSASATTPPRALQVLALLLPVLLLVGLSA

SEQ ID NO: 1840 - protein, 605 aa, Homo sapiens
MGGCFSKPKPVELKIEVVLPEKERGKEELSASGKGSPRAYQGNGTARHFHTEERLSTPHPYPSPQDCVEAAVCHVKDLENGQMREVELGWGKVLLVKDNGEFHALGHKCPHYGAPLVKGVLSRGRVRCPWHGACFNISTGDLEDFPGLDSLHKFQVKIEKEKVYVRASKQALQLQRRTKVMAKCISPSAGYSSSTNVLIVGAGAAGLVCAETLRQEGFSDRIVLCTLDRHLPYDRPKLSKSLDTQPEQLALRPKEFFRAYGIEVLTEAQVVTVDVRTKKVVFKDGFKLEYSKLLLAPGSSPKTLSCKGKEVENVFTIRTPEDANRVVRLARGRNVVVVGAGFLGMEVAAYLTEKAHSVSVVELEETPFRRFLGERVGRALMKMFENNRVKFYMQTEVSELRGQEGKLKEVVLKSSKVVRADVCVVGIGAVPATGFLRQSGIGLDSRGFIPVNKMMQTNVPGVFAAGDAVTFPLAWRNNRKVNIPHWQMAHAQGRVAAQNMLAQEAEMSTVPYLWTAMFGKSLRYAGYGEGFDDVIIQGDLEELKFVAFYTKGDEVIAVASMNYDPIVSKVAEVLASGRAIRKREVELFVLHSKTGDMSWLTGKGS

SEQ ID NO: 1841 - protein, 589 aa, Homo sapiens [sequence omitted]

SEQ ID NO: 1842 - protein, 339 aa, Homo sapiens
MPECWDGEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 1843 - protein, 142 aa, Homo sapiens
MPHLLVTFRDVAIDFSQEEWECLDPAQRDLYRDVMLENYSNLISLEPARTREEQHNLPVPKAGSVNLAAGFGHSRSQTGCGSSKGAEKGLQNVDFYLCPGNHPDTSCRDTYQFFCPDWTCVTLATYSGGSTRSSFHNSCFSS

SEQ ID NO: 1844 - protein, 252 aa, Homo sapiens [sequence omitted]

SEQ ID NO: 1845 - protein, 368 aa, Homo sapiens [sequence omitted]

SEQ ID NO: 1846 - protein, 139 aa, Homo sapiens
MRFQGPTVPRRTLPGQSPKPLVRSQFPLDRRRPSIHLIGQGQTLLWDVWDWHLSPTQIIKAFCSVSCVGMVREEGSHEGGNCIHACMIMRGRDCNRDCVFRDHMHMCRAGACVCLEIVCVAVIISMCYRLCMLALCMCA

SEQ ID NO: 1847 - protein, 107 aa, Homo sapiens
MSENICAGTNLVEADNQAEWTDVQKKIIPWNSRVSDLDLELLFQDRAARLGKSISRLIVVASLIDKPTNLGGPVRYLGLQCSLLAAFSVSATNSFSTSVSLQNSGFL

SEQ ID NO: 1848 - protein, 299 aa, Homo sapiens
MRDLLLHWGPGPPIRAPQEEAEALLELQGRLQEAQDTTEALRAQLGVQEVQLQGLQGALQQLQQETEQNCRRELQQMHGQLAGLRARMASLRQGCGDLRGLVSTFTQSCQGSLSEARGQVSWALGALSSGGPGTQLPEGQQGPPAGCPGRLPELKGNIRVLCRLRPGTSSSLVSVEPGPGGTVTTCYRGRHRRFRLDWVFPPDASQEEVFRELEPAVLSCLRGYSVCIFTYGQTGTGKTYSMEGPPEDPGIVPRALQSLFREMGAGRQHRRYHGRCLSPAESPEHPRPGLPPCRARSPL

SEQ ID NO: 1849 - protein, 127 aa, Homo sapiens [sequence omitted]

SEQ ID NO: 1850 - protein, 552 aa, Homo sapiens [sequence omitted]

SEQ ID NO: 1851 - protein, 135 aa, Homo sapiens
MLYFSLFWAARPLQRCGQLVRMAIRAQHSNAAQTQTGEANRGWTGQESLSDSDPEMWELLQREKDRQCRGLELIASEVGPGEMGRGWATMGTGSNKVILTDISPKPPFTLRTFLWALSSFLISLKQRQCKSSLWG

SEQ ID NO: 1852 - protein, 130 aa, Homo sapiens [sequence omitted]

SEQ ID NO: 1853 - protein, 182 aa, Homo sapiens
MPIPPPPPPPPGPPPPPTFHQANTEQPKLSRDEQRGRGALLQDICKGTKLKKVTNINDRSAPILETPPPPPPVIRNGARDAPPPPPPYRMHGSEPPSRGKPPPPPSRTPAGPPPPPPPPLRNGHRDSITTVRSFLDDFESKYSFHPVEDFPAPEEYKHFQRIYPSKTNRAARGAPPLPPILR

SEQ ID NO: 1854 - protein, 654 aa, Homo sapiens
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQGYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 1855 - protein, 180 aa, Homo sapiens
MQPLPGRLELPGSREAGEGPEDLADGGPLLYRPRGPLTDPGASPSNGCQDSTDTESNHEDRVAGVVSLPQGPPPQPPPTIVVGRHSPAYAKEDPKPQEGLLRGTPGPSKEVLRVVGESGEPVKAFKCEHCRILFLDHVMFTIHMGCHGFRDPFECNICGYHSQDRYEFSSHIVRGEHKVG

SEQ ID NO: 1856 - protein, 107 aa, Homo sapiens [sequence omitted]

SEQ ID NO: 1857 - protein, 200 aa, Homo sapiens
MDSAGQDINLNSPNKGLLSDSMTDVPVDTGVAARTPAVEGLTEAEEEELRAELTKVEEEIVTLRQVLAAKERHCGELKRRLGLSTLGELKQNLSRSWHDVQVSSAYKKTQETLSQAGQKTSAALSTVGSAISRKLGDMSSYSIRHSISMPAMRNSATFKSFEDRVGTIKSKVVGDRENGSDNLPSSAGSGDKPLSDPAPF

SEQ ID NO: 1858 - protein, 131 aa, Homo sapiens
MGGSQRGTCHQQPSLSTFLFSVFFKVFPVARPELFQNEEDTWRNLHVHRPICKRTCEPTLLPQLEELISNTFTQEVFTEHLLCALFSGVGARGQTTLTSLCSQGWSAAARSRLTASSASRVHAILLPQPPE

SEQ ID NO: 1859 - protein, 295 aa, Homo sapiens
MAGWEQKSKALQGRLVRNPSPGTKACGDGQPCPGKFSLKRDTRNAVTVGRPFFDHSSLARHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 1860 - protein, 241 aa, Homo sapiens
MADHTEVMKGIHQYPGVRYPVLTPNLQGFHHAVAAGATEISVFGAASESFSKKNINCSIEESMGKFEEVVKSARHMNIPARGYVSCALGCPYEGSITPQKVTEVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 1861 - protein, 526 aa, Homo sapiens
MVNKDMNGFPVKKCSAFQFFKKRVRRWIKSPMVSVDKHQSPSLKYTGSSMVHIPPGEPDFESSLCQTCLGEHAFQRGVLPQENESCSWETQSGCEVREPCNHANILTKPDPRTFWTNDDPAFMKQRRMGLNDFIQKIANNSYACKHPEVQSILKISQPQEPELMNANPSPPPSPSQQINLGPSSNPHAKPSDFHFLKVIGKGSFGKVLLARHKAEEVFYAVKVLQKKAILKKKEEKHIMSERNVLLKNVKHPFLVGLHFSFQTADKLYFVLDYINGGELFYHLQRERCFLEPRARFYAAEIASALGYLHSLNIVYRDLKPENILLDSQGHIVLTDFGLCKENIEHNSTTSTFCGTPEYLAPEVLHKQPYDRTVDWWCLGAVLYEMLYGLPPFYSRNTAEMYDNILNKPLQLKPNITNSARHLLEGLLQKDRTKRLGAKDDFMEIKSHVFFSLINWDDLINKKITPPFNPNVSGPNDLRHFDPEFTEEPVPNSIGKSPDSVLVTASVKEAAEAFLGFSYAPPTDSFL

SEQ ID NO: 1862 - protein, 133 aa, Homo sapiens
MCARVCLCVCTRVHVTTGAFRVWYKMVLKWQRFFVFVCFVSLKKEKERKIMQNRKHSDWTTGSYSDQSLPLLASYTIVIFMSKEAKTCNTIFSRQKKELSIKCINIFDLNIWMALGASRASILRMECLEKRDF

SEQ ID NO: 1863 - protein, 139 aa, Homo sapiens
MTPSHGLPPALPSSGPRRHQACLCLKALLFPLPKMHFPGLCMTDAGGSMEGDFSEMDSLATFTPPCPRITLFLPVGFATHHHLKASSLWIHLFTCSLSVPLEYKLSKGRDFLCLLHCVLGKLGNLCLEPSRSSIYVLNE

SEQ ID NO: 1864 - protein, 116 aa, Homo sapiens
MEHVNSLLPQGLCTCYSLCLTAHLFSFFVSAHISPFLRGCPRLPIYSSSLSLCYIGLAPWRSLYSPSLHLSSWHLIPPNVFIYFVCLSSLECQFHESKDLVLFTVLSLEPKIVSLQ

SEQ ID NO: 1865 - protein, 133 aa, Homo sapiens [sequence omitted]

SEQ ID NO: 1866 - protein, 393 aa, Homo sapiens
MEENNLQCSSVVDGNFEEVPRETAIQFKPPLYRQRYQFVKNLVDQHEPKKVADLGCGDTSLLRLLKVNPCIELLVGVDINEDKLRWRGDSLAPFLGDFLKPRDLNLTITLYHGSVVERDSRLLGFDLITCIELIEHLDSGDLARFPEVVFGYLFPSMIVISTPNSEFNPLFPSVTLRDSDHKFEWTRMEFQTWALYVANRYDYSVEFTGVGEPPAGAENVGYCTQIGIFRKNGGKATESCLSEQHDQHVYKAVFTTSYPSLQQERFFKLVLVNEVSQQVESLRVSHLPRRKEQAGERGDKPKDIGGSKAPVPCFGPVFTEVEKAKIENSPTPFCVGDKFFVPLQRLLAYPKLNRLCANEEMMRSAIADSIPLSSDGSAVVADLRNYFDEQFEF

SEQ ID NO: 1867 - protein, 312 aa, Homo sapiens
MIFSCPSSDTHSHIICWIFILWNQNTVMLTFFFPGLIMSSGQAWKEQRRFTLTALRNFGLGKKSLEERIQEEAQHLTEAIKEENGQPFDPHFKINNAVSNIICSITFGERFEYQDSWFQQLLKLLDEVTYLEASKTCQLYNVFPWIMKFLPGPHQTLFSNWKKLKLFVSHMIDKHRKDWNPAETRDFIDAYLKEMSKHTGIPTSSFHEENLICSTLDLFFAGTETTSTTLRWALLYMALYPEIQEKVQAEIDRVIGQGQQPSTAARESMPYTNAVIHEVQRMGNIIPLNVPREVTVDTTLAGYHLPKNISPD

SEQ ID NO: 1868 - protein, 101 aa, Homo sapiens [sequence omitted]

SEQ ID NO: 1869 - protein, 457 aa, Homo sapiens
MSNDGRSRNRDRRYDEVPSDLPYQDTTIRTHPILHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPRPANFFVFLVEMGFHRVSQDDLDLLTS

SEQ ID NO: 1870 - protein, 155 aa, Homo sapiens
MRGAAGAAGASSREDGCRVPRPPPTPGGVPSSQLRPERLLPGESPPLCNQPAAAEGAWVPSAEPAAHGRRRTVPWWRSAPATRLATPGRGPGGRGWDLGALRVGPWGMRLGPAGNRAGARRLAGLPATECFDAVFNSANVSLSTLSPSSAQRTVL

SEQ ID NO: 1871 - protein, 435 aa, Homo sapiens
MGGLPSWLLRKPEIHLRTSDPADNMTKIFTLLRKYEPHGPLVNSEYYTGWLDYWGQNHSTRSVSAVTKGLENMLKLGASVNMYMFHGGTNFGYWNGADKKGRFLPITTSYDYDAPISEAGDPTPKLFALRDVISKFQEVPLGPLPPPSPKMMLGPVTLHLVGHLLAFLDLLCPRGPIHSILPMTFEAVKQDHGFMLYRTYMTHTIFEPTPFWVPNNGVHDRAYVMVDGVFQGVVERNMRDKLFLTGKLGSKLDILVENMGRLSFGSNSSDFKGLLKPPILGQTILTQWMMFPLKIDNLVKWWFPLQLPKWPYPQAPSGPTFYSKTFPILGSVGDTFLYLPGWTKGQVWINGFNLGRYWTKQGPQQTLYVPRFLLFPRGALNKITLLELEDVPLQPQVQFLDKPILNSTSTLHRTHINSLSADTLSASEPMELSGH

SEQ ID NO: 1872 - protein, 209 aa, Homo sapiens
MWEAWGVRGCGVAGRGCLREWRAGGYTGQETWPGPIFPCRLPGAPGFYSWGPDPCVARFSVSTWALTTAATMGGRWEGPSPVQGVTAAGTWQLQDRQHFVENDEMYSVQDLLDVHAGRLGCSLTEIHTLFAKHIKLDCERCQAKGFVCELCREGDVLFPFDSHTSVCADCSAVFHRDCYYDNSTTCPKCARLSLRKQSLFQEPGPDVEA

SEQ ID NO: 1873 - protein, 248 aa, Homo sapiens
MGLWSPVPGNSVPRAPVMAGLGLGHSQGAPQGPHDGKTDRSSGPGRRRTERTRLPGLLGGAPLTAGSPHRWNVLGLQGALLSHFVEPVYLQSIVVGSLHHTGHLARVMSHRMEGVGQLPASYRHNRPLLSGVSDAEARQPGKSPPFSMNWVVGSADLEIINATTGRRSCGGPSRLCKHVLSARWARLYGRLSTRTPSPGDTPSMYCEAKLGAHTYQSVKQQLFKAFQKAGLGTWVRKPPEQQQFLLTL

SEQ ID NO: 1874 - protein, 111 aa, Homo sapiens
MCKSLLVLTTKSLRFFKFLLKKNFFLRQTLALSPRLKCSGAISAHCNLCLPGLSDSPASASQVAGITGLCHHAWPIFILLVEMGFCHVGLAGLKPLTSGHPPTSASQSARI

SEQ ID NO: 1875 - protein, 157 aa, Homo sapiens
MSGLCYDSKMFQVHQVLCIPSWMAKFFSWTLEPIFSSSEPTSEARIGMGATLDIQRQQRMELLDRQLMFSQFAQGRRQRQQQGGMINWNRLFPPLRQRQNVNYQGGRQSEPAAPPLEVSEEQVARLMEMGFSRGDALEALRASNNDLNVATNFLLQH

SEQ ID NO: 1876 - protein, 607 aa, Homo sapiens [sequence omitted]

SEQ ID NO: 1877 - protein, 123 aa, Homo sapiens
MNTLARERSSHTSREARLQSSISTPSRLICKSLCFVLSSFLVSSLLLKGGRRLCQHSFSILCPEMCSLRCLLKIVTVVPSLSLSQAQPYLIVPKLQPVHMEWDCTQNIIIKQHRSHQLFLSSQ

SEQ ID NO: 1878 - protein, 181 aa, Homo sapiens
MLEKLTVSYDEAGTTCLIALLSDKDLTVANVGDSRGVLCDKDGNAIPLSHDHKPYQLKERKRIKRAGGFISFNGSWRVQGILAMSRSLGDYPLKNLNVVIPDPDILTFDLDKLQPEFMILASDGLWDAFSNEEAVRFIKERLDEPHFGAKSIVLQSFYRGCPDNITVMVVKFRNSSKTEEQ

SEQ ID NO: 1879 - protein, 1016 aa, Homo sapiens [sequence omitted]

SEQ ID NO: 1880 - protein, 102 aa, Homo sapiens
MPSYPSPSLRTSHAGLLLAGGRQSGCTPGTAGALHRAPGQGGHVEVKPSQLPLCLGVAFGHSTFFACLATSPAQSIVLSLEGMTVSPLCLWVLNPWIRPTLD

SEQ ID NO: 1881 - protein, 112 aa, Homo sapiens
MLVVVSLTHSFISATVLSTTCTRGRGVNKIPFCLGGRPLPMGLAISRKAPQSSTLFWLCVKDVCEQAQSFAARMRGQSIPLHTHPGADRLVPPSLHACPSTGSFAAPAPPAP

SEQ ID NO: 1882 - protein, 166 aa, Homo sapiens [sequence omitted]

SEQ ID NO: 1883 - protein, 122 aa, Homo sapiens
MVPGPPESVVRFFLWFCFLLPPTRKASCDPRDLKSCNRPCVWSRLLKPNSSLSNLETAYFPQNLRFLRPWYFSRSHLNYHQKAPARWEWLYSIYRKGTKAQRRNVLRSPCAPPQPSWPCSVI

SEQ ID NO: 1884 - protein, 579 aa, Homo sapiens [sequence omitted]

SEQ ID NO: 1885 - protein, 672 aa, Homo sapiens
MVSRRPLRDFVGLEDCDKATRDAMLHFSFFVTIGDMDEAFKSIKLIKSEAVWENMARMCVKTQRLDVAKEDAEQLYRKCKRHDLLNKFYQAAGRWQEALQVAEHHDRVHLRSTYHRYAGHLEASADCSRALSYYEKSDTHRFEVPRMLSEDLPSLELYVNKMKDKTLWRWWAQYLESQGEMDAALHYYELARDHFSLVRIHCFQGNVQKAAQIANETGNLAASYHLARQYESQEEVGQAVHFYTRAQAFKNAIRLCKENGLDDQLMNLALLSSPEDMIEAARYYEEKGVQMDRAVMLYHKAGHFSKALELAFATQQFVALQLIAEDLDETSDPALLARCSDFFIEHSQYERAVELLLAARKYQEALQLCLGQNMSITEEMAEKMTVAKDSSDLPEESRRELLEQIADCCMRQGSYHLATKKYTQAGNKLKAMRALLKSGDTEKITFFASVSRQKEIYIMAANYLQSLDWRKEPEIMKNIIGFYTKGRALDLLAGFYDACAQVEIDEYQNYDKAHGALTEAYKCLAKAKAKSPLDQETRLAQLQSRMALVKRFIQARRTYTEDPKESIKQCELLLEEPDLDSTIRIGDVYGFLVEHYVRKEEYQTAYRFLEEMRRRLPLANMSYYVSPQAVDAVHRGLGLPLPRTVPEQVRHNSMEDARELDEEVVEEADDDP

SEQ ID NO: 1886 - protein, 488 aa, Homo sapiens [sequence omitted]

SEQ ID NO: 1887 - protein, 501 aa, Homo sapiens
MGCGLRKLEDPDDSSPGKIFSTLKRPQVETKTEFAYEYVLLDFTLQASSNPEVIKINSILDIVTKVENYYLKGYIVGAIHPVIQPVGQRKHLPASYLYRVVLLRLKLSPKNSAAPSGQRRPRLVIEECPLTSEAQTNDAAKELIEKINVAAKRGMKFVGFISQHYSPSKFCNGTNHDGDIESMLHVRHGSDENCRSWNEGTLSGQSSESGIEEELHHESGQYQMEQNGSPTSSKSRKGEASDNKLYTVFNAFDDDSTSWAYQEGILSMKVTRKGSVISTLDADWLELTTFYYKQGLSLIDSFVFWETSKGEHLPKSLEGFFIYEEEGSGVPGSSRKGNDAIVVEQWTVIEGCEIKTDYGPLLHTLAEFGWLLTSVLPTPVLRHDSEGNLATKQIVFLQRPVMWNSAAQTPDKKASHHIKGEDKNKATSRSIGLDTTSSQPAESRHLPEECRLSPSRECWTKEGRLAQHNSFSGFSSSDNVLRELDDGQFDQEDGVTQVTCM

SEQ ID NO: 1888 - protein, 228 aa, Homo sapiens
MDIRITDATNEAKDNVKYLYTLEKCCDPLYSSDPLSMMDAIPTLINAIKMIYSISHYYNTSEKITSLFVKMTNQIISACKAYITNNGTASIWNQPQDVVEEKILSAIKLKQEYQLCFHKTKQKLKQNPNAKQFDFSEMYIFGKFETFHRRLAKIIDIFTTLKTYSVLQDSTIEGLEDMATKYQGIVATIKKKEYNFLDQRKMDFDQDYEEFCKQTNDLHVGCIIKFLL

SEQ ID NO: 1889 - protein, 164 aa, Homo sapiens
MEGRHLLTEDGAPGLPLQSALPPPPPLPPVRLDGRVALWLRGVRLGGTGAPGKTAGFLLGVPLLEGIEWGWDSAGVSLSTRTPRRPPGPCSVTWADPHPFWAYSTTGRCTPLELPLSGLAGRRLLNSSVLYIQHVPCQLLGRPCLALAEPLLAASQVSLMETPA

SEQ ID NO: 1890 - protein, 260 aa, Homo sapiens
MLSPNRRNLKVWVQSLRSYTGSTQGHNSWTGSNRACSSWTGSTRGHSSWTGSSRACSSWTGSRMIHSLRSSNRAYNSWTGSSHKNHSPPWNPHRSHSPPWSPHRSHSPPWSPHRSHSWCRNRLAPRCTRACSSRQAHNIWSHIPHSWSCSPHSQSHSPHGRSHSPHSQSHNPHSWSHSPHSRSHSLWSSHSSPWFWWIEGGAGRGAGEREVQVWSSLSLGSLYTCPDVRHDTGSLSCDCLHYFSRALFFSSLLVTSFWLS

SEQ ID NO: 1891 - protein, 133 aa, Homo sapiens
MNSAVTSEDSCSKCLIMRRCAGLRRLCDVCTVRKPAFLLLSNLGSAFWNFSALIFPHTPLTATTYHHHNPKQSKQTESLNKNLHLGKRFYSSRVEFLFIPIIDSQLQKSVKSYFGHGSCKKPYLQTFYFKEGI

SEQ ID NO: 1892 - protein, 474 aa, Homo sapiens
MAERFHHVTVLQIHFCDWQQAWERRESLYAHHAQVEKLARKMALRRAFTHWKHYMLLCAEEAAQFEMAEEHHRHSQLYFCFRALKDNVTHAHLQQIRRNLAHQQHGVTLLHRFWNLWRSQIEQKKERELLPLLHAAWDHYRIALLCKCIELWLQYTQKRRYKQLLQARADGHFQQRALPAAFHTWNRLWRWRHQENVLSARATRFHRETLEKQVFSLWRQKMFQHRENRLAERMAILHAEQQLLYRSWFMWHQQAAARHQEQEWQTVACAHHRHGRLKKAFCLWRESAQGLRTESWSSGGKLCQCRCITDSRRTVPSGRPRRCWTGAVCGPGFSAGGTAAGGQPSRDCSWRGQCNTTTGSCCWRGWPGGRRTICSVSGRGSCTGRAPNCWHRDSAGPASASGDNSWQPGGRSSGRQCGPCGSGPSRCRQRCGPRGWPLYWKGGERRRGCSGRSRPTRGSSSRRVPRGSCALQPA

SEQ ID NO: 1893 - protein, 297 aa, Homo sapiens [sequence omitted]

SEQ ID NO: 1894 - protein, 159 aa, Homo sapiens
MSLITCKFKNLGNLHAGGCGYIPLSSTREERVKNGSRVVSTALLSSYHKGIAFVIFPSHHHTPTRPPSPKPSGSGGYLLNLRRRDPPQAFLSGCPPLPPRGSVLLGCTPPRTQFFVFHVVSYPLVLQKLLQTRDQKSIGSNSSCDTSEMSDCWQVTLSI

SEQ ID NO: 1895 - protein, 939 aa, Homo sapiens
MEAVPRMPMIWLDLKEAGDFHFQPAVKKFVLKNYGENPEAYNEELKKLELLRQNAVRVPRDFEGCSVLRKYLGQLHYLQSRVPMGSGQEAAVPVTWTEIFSGKSVAHEDIKYEQACILYNLGALHSMLGAMDKRVSEEGMKVSCTHFQCAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFTMDVIGGKYNSAKKDNDFIYHEAVPALDTLQPVKGAPLVKPLPVNPTDPAVTGPDIFAKLVPMAAHEASSLYSEEKAKLLREMMAKIEDKNEVLDQFMDSMQLDPETVDNLDAYSHIPPQLMEKCAALSVRPDTVRNLVQSMQVLSGVFTDVEASLKDIRDLLEEDELLEQKFQEAVGQAGAISITSKAELAEVRREWAKYMEVHEKASFTNSELHRAMNLHVGNLRLLSGPLDQVRAALPTPALSPEDKAVLQNLKRILAKVQEMRDQRVSLEQQLRELIQKDDITASLVTTDHSEMKKLFEEQLKKYDQLKVYLEQNLAAQDRVLCALTEANVQYAAVRRVLSDLDQKWNSTLQTLVASYEAYEDLMKKSQEGRDFYADLESKVAALLERTQSTCQAREAARQQLLDRELKKKPPPRPTAPKPLLPRREESEAVEAGDPPEELRSLPPDMAAGPRLPDTFLGSATPLHFPPSPFPSSTGPGPHYLSGPLPPGTYSGPTQLIQPRAPGPHAMPVAPGPALYPAPAYTPELGLVPRSSPQHGVVSSPYVGVGPAPPVAGLPSAPPPQFSGPELAMAVRPATTTVDSIQAPIPSLLLPFLLPLALPGPACTPVGWKCTAGSGSGSAPLWDPTFFSSLLLK

SEQ ID NO: 1896 - protein, 279 aa, Homo sapiens
MLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRASYYEISVDDGPWEKQKSSGLNLCTGTGSKAWSFNINRVATQAVEDVLNIAKRQGNLSLPLNRELVEKVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 1897 - protein, 177 aa, Homo sapiens
MTSSSIHVATNDRIPFFFIILSIHTTFSISIYLLMDTGCKGIAGLYDNSMCSFLRNLHGVLHSGCTTVHSYQWWMSVPLSPHPHKHLLFFLFFQMNILTGVRYLNVVLVYISLIMVEHFFTYLMAIHMSSFEKCLYRSLALFLNFFFFELGSPSLEVIWASTSWAQVIIPPQDDPNS

SEQ ID NO: 1898 - protein, 207 aa, Homo sapiens
MAEDLDELLDEVESKFCTPDLLRRGMVEQPKGCGGGTHSSDRNQAKAKETLRSTETFKKEDDLDSLINEILEEPNLDKKPSKLKSKSSGNTSVRASIEGLGKSCSPVYLGGSSIPCGIGTNISWRACDHLRCIACDFLVVSYDDYMWDKSCDYLFFRNNMPEFHKLKAKLIKKKGTRAYACQCSWRTIEEVTDLQTDHQLRWVCGKH

SEQ ID NO: 1899 - protein, 107 aa, Homo sapiens [sequence omitted]

SEQ ID NO: 1900 - protein, 457 aa, Homo sapiens [sequence omitted]

SEQ ID NO: 1901 - protein, 137 aa, Homo sapiens
MKDKMWCEDTAQPHRRLPAPPSSSSPTVVFQPHRRLLAPPSSSWTLWVAPRCGCCSPLCPKRVCASLCRVLAVTWSLTKLPFPLSPILLSRPGWLPQPSSPGPACAEPSSQEGGDTDLRSYGCFVCGWAWPTLSPRP

SEQ ID NO: 1902 - protein, 907 aa, Homo sapiens
MSERDQVISELDKLQTEVELAESKLKSSTSEKKAANEEMEALRQIKDTVTMDAGRANKEVEILRKQCKALCQELKEALQEADVAKCRRDWAFQERDKIVAERDSIRTLCDNLRRERDRAVSELAEALRSLDDTRKQKNDVSRELKELKEQMESQLEKEARFRQLMAHSSHDSAIDTDSMEWETEVVEFERETEDIDLKALGFDMAEGVNEPCFPGDCGIFVTKVDKGSIADGRLRVNDWLLRINDVDLINKDKKQAIKALLNGEGAINMVVRRRKSLGGKVVTPLHINLSGQKDSGISLENGVYAAAVLPGSPAAKEGSLAVGDRIVAINGIALDNKSLNECESLLRSCQDSLTLSLLKVFPQSSSWSGQNIFENIKDSDKMLSFRAHGPEVQAHNKRNLIQHNNSTQTDIFYTDRLEDRKEPGPPGGSSSFLHKPFPGGPLQVCPQACPSASERSLSSFRSDASGDRGFGLVDVRGRRPLLPFETEVGPCGVGEASLDKADSEGSNSGGTWPKAMLSSTAVPEKLSVYKKPKQRKSIFDPNTFKRPQTPPKIDYLLPGPGPAHSPQPSKRAGPLTPPKPPRRSDSIKFQHRLETSSESEATLVGSSPSTSPPSALPPDVDPGEPMHASPPRKARVRIASSYYPEGDGDSSHLPAKKSCDEDLTSQKVDELGQKRRRPKSAPSFRPKLAPVVIPAQFLEEQKCVPASGELSPELQEWAPYSPGHSSRHSNPPLYPSRPSVGTVPRSLTPSTTVSSILRNPIYTVRSHRVGPCSSPPAARDAGPQGLHPSVQHQGRLSLDLSHRTCSDYSEMRATHGSNSLPSSARLGSSSNLQFKAERIKIPSTPRYPRSVVGSERGSVSHSECSTPPQSPLNIDTLSSCSQSQTSASTLPRIAVNPASLGERRKDS

SEQ ID NO: 1903 - protein, 126 aa, Homo sapiens [sequence omitted]

SEQ ID NO: 1904 - protein, 405 aa, Homo sapiens
MNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNCMPSTLGVQCRRCCPGPDYAWSQAGGRGRTPGATTHTRDKTTCACCLISSQTSDCFSFPALPFLPLVFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 1905 - protein, 1095 aa, Homo sapiens [sequence omitted]

SEQ ID NO: 1906 - protein, 566 aa, Homo sapiens [sequence omitted]

SEQ ID NO: 1907 - protein, 522 aa, Homo sapiens
MTPRQEGTDNEDPVVCLDKKPVIIIFDEPMDIRSAYKRLSTIFEECDEELERMMMEEKIEEEEEEENGDSVVQNNNTSQMSHKKVAPGNLRTGQQVETKSQPHSLATETRNPGGQEMNRTELNKFSHVDSPNSECKGEDATDDQFESPKKKFKFKFPKKQLAALTQAIRTGTKTGKKTLQVVVYEEEEEDGTLKQHKEAKRFEIARSQPEDTPENTVRRQEQPSIESTSPISRTDEIRKNTYRTLDSLEQTIKQLENTISEMSPKALVDTSCSSNRDSVASSSHIAQEASPRPLLVPDEGPTALEPPTSIPSASRKGSSGAPQTSRMPVPMSAKNRPGTLDKPGKQSKLQDPRQYRQANGSAKKSGGDFKPTSPSLPASKIPALSPSSGKSSSLPSSSGDSSNLPNPPATKPSIASNPLSPQTGPPAHSASLIPSVSNGSLKFQSLTHTGKGHHLSFSPQSQNGRAPPPLSFSSSPPSPASSVSLNQGAKGTRTIHTPSLTSYKAQNGSSSKATPSTAKETS

SEQ ID NO: 1908 - protein, 146 aa, Homo sapiens
MFHTVTKCLMSRDRFLKMRGMEILGNLCKAEDNGVLICEYVDQDSYREIICHLTLPDVLLVISTLEVLYMLTEMGDVACTKIAKVEKSIDMLVCLVSMDIQMFGPDALAAVKLIEHPSSSHQMLSEIRPQAIEQVQTQTHVASAPG

SEQ ID NO: 1909 - protein, 1058 aa, Homo sapiens
MVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKCYEAGHLENGITESCATSYSKDFGGGTTKIFDKPRKRKRQRHAAAKMQCKKVKNDDSSKEIPGSEGELMPHRTATSPKETVEEGVEHDPGMPASKKMQGERGGGAALKENVCQNCEKLGELLLCEAQCCGAFHLECLGLTEMPRGKFICNECRTGIHTCFVCKQSGEDVKRCLLPLCGKFYHEECVQKYPPTVMQNKGFRCSLHICITCHAANPANVSASKGRLMRCVRCPVAYHANDFCLAAGSKILASNSIICPNHFTPRRGCRNHEHVNVSWCFVCSEGGSLLCCDSCPAAFHRECLNIDIPEGNWYCNDCKAGKKPHYREIVWVKVGRYRWWPAEICHPRAVPSNIDKMRHDVGEFPVLFFGSNDYLWTHQARVFPYMEGDVSSKDKMGKGVDGTYKKALQEAAARFEELKAQKELRQLQEDRKNDKKPPPYKHIKVNRPIGRVQIFTADLSEIPRCNCKATDENPCGIDSECINRMLLYECHPTVCPAGGRCQNQCFSKRQYPEVEIFRTLQRGWGLRTKTDIKKGEFVNEYVGELIDEEECRARIRYAQEHDITNFYMLTLDKDRIIDAGPKGNYARFMNHCCQPNCETQKWSVNGDTRVGLFALSDIKAGTELTFNYNLECLGNGKTVCKCGAPNCSGFLGVRPKNQPIATEEK

SEQ ID NO: 1910 - protein, 314 aa, Homo sapiens
MVAEEGGVPADEVILVELYPSGFQRSFFDEEDLNTIAEGDNVYAFQVPPSPSQGTLSAHPLGLSASPRLAAREGQRFSLSLHSESKVLILFCNLVGSGQQASRFGPPFLIREDRAVSWAQLQQSILSKVRHLMKSEAPVQNLGSLFSIRVVGLSVACSYLSPKDSRPLCHWAVDRVLHLRRPGGPPHVKLAVEWDSSVKERLFGSLQEERAQDADSVWQQQQAHQQHSCTLDECFQFYTKEEQLAQDDAWKCPHCQVLQQGMVKLSLWTLPDILIIHLKRFCQVGERRNKLSTLVKFPLSGLNMAPHRPEKHQP

SEQ ID NO: 1911 - protein, 1174 aa, Homo sapiens
MSRDFQAWLDTKKEEQNKSHPISAKLDVLESLIKDHKDFSKTLTAQSHMYEKTIAEGENLLLKTQGSEKAALQLQLNTIKTNWDTFNKQVKERENKLKESLEKALKYKEQVETLWPWIDKCQNNLEEIKFCLDPAEGENSIAKLKSLQKEMDQHFGMVELLNNTANSLLSVCEIDKEVVTDENKSLIQKVDMVTEQLHSKKFCLENMTQKFKEFQEVSKESKRQLQCAKEQLDIHDSLGSQAYSNKYLTMLQTQQKSLQALKHQVDLAKRLAQDLVVEASDSKGASDVLLQVETIAQEHSTLSQQVDEKCSFLETKLQGIGHFQNTIREMFSQFAEFDDELDSMAPVGRDAETLQKQKETIKAFLKKLEALIASNDNANKTCKMMLATEETSPDLVGIKRDLEALSKQCNKLLDRAQAREEQVEGTIKRLEEFYSKLKEFSILLQKAEEHEESQGPVGMETETINQQLNMFKVFQKEEIEPLQGKQQDVNWLGQGLIQSAAKSTSTQGLEHDLDDVNARWKTLNKKVAQRAAQLQEALLHCGRFQDALESLLSWMVDTEELVANQKPPSAEFKVVKAQIQEQKLLQRLLDDRKSTVEVIKREGEKIATTAEPADKVKILKQLSLLDSRWEALLNKAETRNRQLEGISVVAQQFHETLEPLNEWLTTIEKRLVNCEPIGTQASKLEEQIAQHKALEDDIINHNKHLHQAVSIGQSLKVLSSREDKDMVQSKLDFSQVWYIEIQEKSHSRSELLQQALCNAKIFGEDEVELMNWLNEVHDKLSKLSVQDYSTEGLWKQQSELRVLQEDILLRKQNVDQALLNGLELLKQTTGDEVLIIQDKLEAIKARYKDITKLSTDVAKTLEQALQLARRLHSTHEELCTWLDKVEVELLSYETQVLKGEEASQAQMRPKELKKEAKNNKALLDSLNEVSSALLELVPWRAREGLEKMVAEDNERYRLVSDTITQKVEEIDAAILRSQQFDQAADAELSWITETEKKLMSLGDIRLEQDQTSAQLQVQKTFTMEILRHKDIIDDLVKSGHKIMTACSEEEKQSMKKKLDKVLKNYDTICQINSERYLQLERAQSLVNQFWETYEELWPWLTETQSIISQLPAPALEYETLRQQQEEHRQLRELIAEHKPHIDKMNKTGPQLLELSPGEGFSIQEKYVAADTLYS

SEQ ID NO: 1912 - protein, 440 aa, Homo sapiens
MPVFLDPADIATLEGISWRLPSAPSDEASFPGKEALAAFLGWFDYCDHLITEAHTVVADALAKAVAENFFVETLQPQLLHVSEQSILTSTALLTAMLRQLRSPALLREAVAFLLGTDRQPEAPGDNPHTLYAHLIGHCDHLSDEISITTLRLFEELLQKPHEGIIHSLVLRNLEGRPYVAWGSPEPESYEDTLDLEEDPYFTDSFLDSGFQTPAKPRLAPATSYDGKTAVTEIVNSFLCLVPEEAKTSAFLEETGYDTYVHDAYGLFQECSSRVASWGWPLTPTPLDPHEPERPFFEGHFLRVLFDRMSRILDQPYSLNLQVTSVLSRLALFPHPHIHEYLLDPYISLAPGCRSLFSVLVRVIGDLMQRIQRVPQFPGKLLLVRKQLTGQAPGEQLDHQTLLQGVVVLEEFCKELAAIAFVKFPPHDPRQNVSPAPEGQV

SEQ ID NO: 1913 - protein, 890 aa, Homo sapiens
MELTSIHKPTDKRKMCNQKENPTKKEDHEKLSQNTLPVIGVWEFERDDDEYIKFLDLFLSYILERDLPYSRDADIPFLTSFSGKLREHELNSLLFDVHTTLKRHQSKTKSQNVFRAGSCFVVAPESYESEKSSSLNDEYGMHLENQKLSSSVLVNQGIKPFLQYPSNEVNKNEGMSGLFGLKQRSIYKIQDDTREKCLIQRSSNHIFWTPKSIKTRRCIFKAIQCNDINPQEDLPLALNTFGSIGRLLEWMIRWSNRRLLCDSGITESSSEYSPVIRVKTSTAAILTSLWLLEQPYFATYKAKNAIIKMVENRDTGCQIGPNIERESKSDAGGSVAVATPGGTEERNGQNKSCQNILNKMPTEAKNPDIKEINDDIISITHNTKKEFIDIDENLLEVEAFTEEEMDMHISDYEDIEESVGGFRSPSLAICMMTLPQQLEEEFTEEVQCQREEPLETIMEEKSTEQKGMIEAFSHPGHTTPQSMQVDTSSEISSAQISTYKEKSSSVPLLISNGVNVASQPPAPTPQKTQRNEFTAQLPDCSESVRQMLQDEMFKLVQLQQINFMSLMQIVGSSFANLPDTQQLVQQSQSVHLGESQESNLRGCGDVEDSNKNLKERFFIKPQSMGENAREPRKNSPHCHEGTIPSGQNSTGNVQNVPHGSIPLCQLNGQPRKKGPIPSSQNLPSTSFYPAPAGNTHLYLLSTPSVVQKAPRLIPHAKTFSPGDGFPLLQFKSKQEFQPLFLHTGSIPQVPFRPLPQPREAWGLSDSFQPALPQRAAQTTPASHLNVSQYNTEARKKEVEQKTWAETVITEIPNHVNLDQYVGQENLTPQQDSSVFIKPEKLFDVKPGTLEISPHHSFGLPLLYLPLKPPNMFPSTSRASITVPSTPIQPI

SEQ ID NO: 1914 - protein, 603 aa, Homo sapiens
MSSSTEVSRCIAHLHRTELHGQLISVEKVKGDPSKKEMKKENDEKSSSRSSGDKKNTSDRSSKTQASVKKEEKRSSEKSEKKESKDTKKIEGKDEKNDNGASGQTSESIKKSEEKKRISSKSPGHMVILDQTKGDHCRPSRRGRYEKIHGRSKEKERASLDKKRDKDYRRKEILPFEKMKEQRLREHLVRFERLRRAMELRRRREIAERERRERERIRIIREREERERLQRERERLEIERQKLERERMERERLERERIRIEQERRKEAERIAREREELRRQQQQLRYEQEKRNSLKRPRDVDHRRDDPYWSENKKLSLDTDARFGHGSDYSRQQNRFNDFDHRERGRFPESSAVQSSSFERRDRFVGQSEGKKARPTARREDPSFERYPKNFSDSRRNEPPPPRNELRESDRREVRGERDERRTVIIHDRPDITHPRHPREAGPNPSRPTSWKSEGSMSTDKRETRVERPERSGREVSGHSVRGAPPGNRSSASGYGSREGDRGVITDRGGGSQHYPEERHVVERHGRDTSGPRKEWHGPPSQGPSYHDTRRMGDGRAGAGMITQHSSNASPINRIVQISGNSMPRGSGSGFKPFKGGPPRRF

SEQ ID NO: 1915 - protein, 122 aa, Homo sapiens
MRVKGYKALPPFQLPTCSSSTPLRFGPPRTNEVHTLWMRKRGSWLASLLPVIQFEDILTLGKDEVLKPQLLSTRSHSSWGRQRGKSLSKVYPASLRFIDLHKRQCSGKGRGPQKGAWQDRGC

SEQ ID NO: 1916 - protein, 298 aa, Homo sapiens
MWSPRLWSVRFLGARKSADPKRPCDHPAWAHKKTHVRRERAREGSSFRKGFRLDTDDGQLPRAAPERTDAKPTAFPCQVLTQRCGRRPGRRERRKQRAVELSFICGTCGKALSCHSRLLAHQTVHTGTKAFECPECGQTFRWASNLQRHQKNHTREKPFCCEACGQAFSLKDRLAQHRKVHTEHRPYSCGDCGKAFKQKSNLLRHQLVHTGERPFYCADCGKAFRTKENLSHHQRVHSGEKPYTCAECGKSFRWPKGFSIHRRLHLTKRFYECGHCGKGFRHLGFFTRHQRTHRHGEV

SEQ ID NO: 1917 - protein, 799 aa, Homo sapiens
MPWPFSESIKKRACRYLLQRYLGHFLQEKLSLEQLSLDLYQGTGSLAQVPLDKWCLNEILESADAPLEVTEGFIQSISLSVPWGSLLQDNCALEVRGLEMVFRPRPRPATGSEPMYWSSFMTSSMQLAKECLSQKLTDEQGEGSQPFEGLEKFAETIETVLRRVKVTFIDTVLRIEHVPENSKTGTALEIRIERTVYCDETADESSGINVHQPTAFAHKLLQLSGVSLFWDEFSASAKSSPVCSTAPVETEPKLSPSWNPKIIYEPHPQLTRNLPEIAPSDPVQIGRLIGRLELSLTLKQNEVLPGAKLDVDGQIDSIHLLLSPRQVHLLLDMLAAIAGPENSSKIGLANKDRKNRPMQQEDEYRIQMELNRYYLRKDSLSVGVSSEQSFYETETARTPSSREEEVFFSMADMDMSHSLSSLPPLGDPPNMDLELSLTSTYTNTPAGSPLSATVLQPTWGEFLDHHKEQPVRGSTFPSNLVHPTPLQKTSLPSRSVSVDESRPELIFRLAVGTFSISVLHIDPLSPPETSQNLNPLTPMAVAFFTCIEKIDPARFSTEDFKSFRAVFAEACSHDHLRFIGTGIKVSYEQRQRSASRYFSTDMSIGQMEFLECLFPTDFHSVPPHYTELLTFHSKEETGSHSPVCLQLHYKHSENRGPQGNQARLSSVPHKAELQIKLNPVCCELDISIVDRLNSLLQPQKLATVEMMASHMYTSYNKHISLHKAFTEVFLDDSHSPANCRISVQVATPALNLSVRFPIPDLRSDRERGPWFKKSLQKEILYLAFTDLEFKTEFIGGSTP

SEQ ID NO: 1918 - protein, 147 aa, Homo sapiens [sequence omitted]

SEQ ID NO: 1919 - protein, 832 aa, Homo sapiens
MAMRSGRHPSLLLLLVLLLWLLQVSIIDSVQQETDDLTKQTKEKIYQPLRRSKRRWVITTLELEEEDPGPFPKLIGELFNNMSYNMSLMYLISGPGVDEYPEIGLFSLEDHENGRIYVHRPVDREMTPSFTVYFDVVERSTGKIVDTSLIFNIRISDVNDHAPQFPEKEFNITVQENQSAGQPIFQMLAVDLDEENTPNSQVLYFLISQTPLLKESGFRVDRLSGEIRLSGCLDYETAPQFTLLIRARDCGEPSLSSTTTVHVDVQEGNNHRPAFTQENYKVQIPEGRASQGVLRLLVQDRDSPFTSAWRAKFNILHGNEEGHFDISTDPETNEGILNVIKPLDYETRPAQSLIIVVENEERLVFCERGKLQPPRKAAASATVSVQVTDANDPPAFHPQSFIVNKEEGARPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKDLEEVPPSAASQSAQARCALGSWGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 1920 - protein, 1132 aa, Homo sapiens
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKSLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQL

SEQ ID NO: 1921 - protein, 811 aa, Homo sapiens
METSSMLSSLNDECKSDNYIEPHYKEWYRVAIDILIEHGLEAYQEFLVQERVSDFLAEEEINYILKNVQKVAQSTAHGTDDSCDDTLSSGTYWPVESDVEAPNLDLGWPYVMPGLLGGTHIDLLFHPPRAHLLTIKETIRKMIKEARKVIALVMDIFTDVDIFKEIVEASTRGVSVYILLDESNFNHFLNMTEKQGCSVQRLRNIRVRTVKGQDYLSKTGAKFHGKMEQKFLLVDCQKVMYGSYSYMWSFEKAHLSMVQIITGQLVESFDEEFRTLYARSCVPSSFAQEESARVKHGKALWENGTYQHSVSSLASVSSQRNLFGRQDKIHKLDSSYFKNRGIYTLNEHGKYNIRSHGYKPHFVPNFNGPNAIRQFQPNQINENWKRHSYAGEQPETVPYLLLNRALNRTNNPPGNWEKPSDSLSVASSSREGYVSHHNTPAQSFANRLAQRKTTNLADRNSNVRRSFNGTDNHIRFLQQRMPTLEHTTKSFLRNWRIESYLNDHSEATPDSNGSALGDRFEGYDNPENLKANALYTHSRLSSSLVFKPTLPEQKEVNSCTTGSSNSTIIGSQGSETPKEVPDTPTNVQHLTDKPLPESIPKLPLQSEAPKMHTLQVPENHSVALNQTTNGHTESNNYIYKTLGVNKQTENLKNQQTENLLKRRSFPLFDNSKANLDPGNSKHYVYSTLTRNRVRQPEKPKEDLLKSSKSMHNVTHNLEEDEEEVTKRNSPSGTTTKSVSIAALLDVNKEESNKELASKKEVKGSPSFLKKGSQKLRSLLSLTPDKKENLSKNKAPAFYRLCSSSDTLVSEG

SEQ ID NO: 1922 - protein, 187 aa, Homo sapiens
MDYTATIYLRQRWMDQRLVFEGNKSFTLDEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGDNKGSRRSQYY

SEQ ID NO: 1923 - protein, 302 aa, Homo sapiens [sequence omitted]

SEQ ID NO: 1924 - protein, 747 aa, Homo sapiens
MEAAQEGHLELVKYLIAAGANVHATTATGDTALTYACENGHTDVADVLLQAGADLEHESEGGRTPLMKAARAGHVCTVQFLISKGANVNRTTANNDHTVLSLACAGGHLAVVELLLAHGADPTHRLKDGSTMLIEAAKGGHTSVVCYLLDYPNNLLSAPPPDVTQLTPPSHDLNRAPRVPVQALPMVVPPQEPDKPPANVATTLPIRNKAVSGRASAMSNTPTHSIAASISQPQTPTPSPIISPSAMLPIYPAIDIDAQTESNHDTALTLACAGGHEELVQTLLERGASIEHRDKKGFTPLILAATAGHVGVVEILLDNGADIEAQSERTKDTPLSLACSGGRQEVVELLLARGANKEHRNVSDYTPLSLAASGGYVNIIKILLNAGAEINSRTGSKLGISPLMLAAMNGHTAAVKLLLDMGSDINAQIETNRNTALTLACFQGRTEVVSLLLDRKANVEHRAKTGLTPLMEAASGGYAEVGRVLLDKGADVNAPPVPSSRDTALTIAADKGHYKFCELLIGRGAHIDVRNKKGNTPLWLAANGGHLDVVQLLVQAGADVDAADNRKITPLMAAFRKGHVKVVRYLVKEVNQFPSDSECMRYIATITDKEMLKKCHLCMESIVQAKDRQAAEANKNASILLEELDLEKLREESRRLALAAKREKRKEKRRKKKEEQRRKLEEIEAKNKENFELQAAQEKEKLKVEDEPEVLTEPPSATTTTTIGISATWTTLAGSHGKRNNTITTTS

SEQ ID NO: 1925 - protein, 108 aa, Homo sapiens
MKKDWLFAPHYRYYVREMRIHAYSQLLESYRSLTLGYMAEAFGVGVEFIDQELSRFIAAGRLHCKIDKVNEIVETNRPDSKNWQYQETIKKGDLLLNRVQKLSRVINM

SEQ ID NO: 1926 - protein, 450 aa, Homo sapiens [sequence omitted]

SEQ ID NO: 1927 - protein, 225 aa, Homo sapiens
MLWIGKPEPYLWEVDSWGPPTLLGEVAFGGNGHRSDLRRLGRHGCPLGAILREYGPVWGSVRVGRGPGKPLRFSAPSRHGCNPSYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 1928 - protein, 688 aa, Homo sapiens
MAAEIDFLREQNRRLNEDFRRYQMESFSKYSSVQKAVCQGEGDDTFENLVFDQSFLAPLVTEYDKHLGELNGQLKYYQKQVGEMKLQLENVIKENERLHSELKDAVEKKLEAFPLGTEVGTDIYADDETVRNLQEQLQLANQEKTQAVELWQTVSQELDRLHKLYQEHMTEAQIHVFESQKQKDQLFDFQQLTKQLHVTNENMEVTNQQFLKTVTEQSVIIEQLRKKLRQAKLELRVAVAKVEELTNVTEDLQGQMKKKEKDVVSAHGREEASDRRLQQLQSSIKQLEIRLCVTIQEANQLRTENTHLEKQTRELQAKCNELENERYEAIVRARNSMQLLEEANLQKSQALLEEKQKEEDIEKMKETVSRFVQDATIRTKKEVANTKKQCNIQISRLTEELSALQMECAEKQGQIERVIKEKKAVEEELEKIYREGRGNECDYRKLEEMHQRFLVSERSKDDLQLRLTRAENRIKQLETDSSEEISRYQEMIQKLQNVLESERENCGLVSEQRLKLQQENKQLRKETESLRKIALEAQKKAKVKISTMEHEFSIKERGFEVQLREMEDSNRNSIVELRHLLATQQKAANRWKEETKKLTESAEIRINNLKSELSRQKLHTQELLSQLEMANEKVAENEKLILEHQEKANRLQRRLSQAEERAASASQQLSVITVQRRKAASLMNLENI

SEQ ID NO: 1929 - protein, 195 aa, Homo sapiens
MAAPPGEYFSVGSQVSCRTCQEQRLQGEVVAFDYQSKMLALKCPSSSGKPNHADILLINLQYVSEVEIINDRTETPPPLASLNVSKLASKARTEKEEKLSQAYAISAGVSLEGQQLFQTIHKTIKDCKWQEKNIVVMEEVVITPPYQVENCKGKEGSALSHVRKIVEKHFRDVESQKILQRSQAQQPQKEAALSS

SEQ ID NO: 1930 - protein, 324 aa, Homo sapiens
MDRSLPVFSIQDSPFGDAPLGRSHYWPSQSQTWCPKTLSPSRSQRSRLPQAPKALATGPNSPELFEESWPSSSGTPSLPSTTEGQMWASPAPTLIDSGDSVVAKYINRFRQAQPTSREERQPAGPTPADFWWLQSDSPDPSSQSAAGANKPEGRPHTAVPTAVNVTSASHAVAPLQEIKQNLHTWNSSLLDLETLSLQSRAARLLKRSSSDASTSSFPTSSDGLSPFSETFIPDSSKGLGPRAPASPAPAQAQTPTPAPAPASSQAPLRPEDDILYQWRQRRKLEQAQGSKGDRAWVPPLTPALRTLVSRGREEPGGSWRRGWV

SEQ ID NO: 1931 - protein, 110 aa, Homo sapiens [sequence omitted]

SEQ ID NO: 1932 - protein, 588 aa, Homo sapiens
MAAPALALVSFEDVVVTFTGEEWGHLDLAQRTLYQEVMLETCRLLVSLGHPVPKPELIYLLEHGQELWTVKRGLSQSTCAGEKAKPKITEPTASQLAFSEESSFQELLAQRSSRDSRLGQARDEEKLIKIQEGNLRPGTNPHKEICPEKLSYKHDDLEPDDSLGLRVLQERVTPQDALHECDSQGPGKDPMTDARNNPYTCTECGKGFSKKWALVRHQQIHAGVKPYECNECGKACRYMADVIRHMRLHTGEKPYKCIECGKAFKRRFHLTEHQRIHTGDKPYECKECGKAFTHRSSFIQHNMTHTREKPFLCKECGKAFYYSSSFAQHMRIHTGKKLYECGECGKAFTHRSTFIQHNVTHTGEKPFLCKECGKTFCLNSSFTQHMRIHTGEKPYECGECGKAFTHRSTFIRHKRTHTGEKPFECKECGKAFCDSSSLIQHMRIHTGEKPYECSECGKAFTHHSVFIRHNRTHSGQKPLECKECAKAFYYSSSFTRHMRIHTGEKPYVCRECGKAFTQPANFVRHNRIHTGEKPFECKECEKAFCDNFALTQHMRTHTGEKPFECNECGKTFSHSSSFTHHRKIHTRV

SEQ ID NO: 1933 - protein, 100 aa, Homo sapiens
MKNKSQWVMLPVASSMSWVIVRIKQCRILKHFCSSKMALSSTGYILLLGVNCMVLVNYIFLTDCELSHGWHSCHVKIMFCQVLSSHTIAFLLEQNKKLIF

SEQ ID NO: 1934 - protein, 305 aa, Homo sapiens
MELHYLAKKSNQADLCDARDWSSRGLPGDQADTAATRAALCCQKQCASTPRATEMEGSKLSSSPASPSSSLQNSTLQPDAFPPGLLHSGNNQITAERKVCNCCSQELETSFTYVDKNINLEQRNRSSPSAKGHNHPGELGWENPNEWSQEAAISLISEEEDDTSSEATSSGKSIDYGFISAILFLVTGILLVIISYIVPREVTVDPNTVAAREMERLEKESARLGAHLDRCVIAGLCLLTLGGVILSCLLMMSMWKGELYRRNRFASSKESAKLYGSFNFRMKTSTNENTLELSLVEEDALAVQS

SEQ ID NO: 1935 - protein, 114 aa, Homo sapiens
MGRTDPLTGLQSLEGSIGQGNGGHVTSCRAPCHRPKEQLCPLSVGGPGGEVDRHLPPTGIWQQEPGPLCKKGRPKGEQWPIKTLENKHPFPRWLQIITSCKSTPGEQLTFISLS

SEQ ID NO: 1936 - protein, 473 aa, Homo sapiens
MASRSLGGLSGIRGGGGGGGKKSLSARNAAVERRNLITVCRFSVKTLIDRSCFETIDDSSPEFNNFAAILEQILSHRLKEISQSCRWLAHLQIPLQGQVTWFGYESPRSFWDYIRVACRKVSQNCICSIENMENVSSSRAKGRAWIRVALMEKHLSEYISTALRDFKTTRRFYEDGAIVLGEEANMLAGMLLGLNAIDFSFCLKGEGLDGSFPAVIDYTPYLKYIQSSDSISSDEEELRTLGSSGSESSTPENVGPPFLMDENSWFNKCKRVKQKYQLTLEQKGYLEELLRLRENQLSESVSQNKILLQRIEDSDLAHKLEKEQLEYIIVELQDQLTVLKNNDLRSRQELTAHLTNQWPSPGALDVNAVALDTLLYRKHNKQWYEKSYQSLDQLSAEVSLSQTSLDPGQSQEGDGKQDTLNVMSEGKEDTPSLLGLCGSLTSVASYKSLTSLKSNDYLASPTTEMTSPGLTPS

SEQ ID NO: 1937 - protein, 123 aa, Homo sapiens
MGRMSLGHVRDLHCSLSHYRPGGLEGKKWFSGPGLRHPPLLFAALKHGTLRPQLLQLQLWLKGANIQLRPLFQRVQSPSFGSLHMVLGLQEHRSQELRFGNLCLDFRGCMEMPGCPDRSLLQG

SEQ ID NO: 1938 - protein, 204 aa, Homo sapiens
MCVTDKTRPPSSSWFPMPAKYMTFLGPLTSFAVLHLMTFPLYLPCCAGKEAKWKSVSSSGRKAAVPALLRTAPKTPWDGPESAESQPLPLGLLWCWTSVTDGSRRPSRLREARGACEDEVWLPLLPAALCWLCLKWNQDCGDALASPAEQPAELYHRRPHCSQGLGRRCLAGAAGGETRDDSCSDSGLAQERGKVWSRSDSGTR

SEQ ID NO: 1939 - protein, 151 aa, Homo sapiens
MADHNPDSDSTPRTLLRRVLDTADPRTPRRPRSARAGARRALLETASPRKLSGQTRTIARGRSHGARVSTQPTDPKGPWLPRGGGLRSSSALEPTLRKSQGRRTDWLLGASPIVCWQIGPYSGQWALGGTDTSDAAEEHPTNCPRIFHPDA

SEQ ID NO: 1940 - protein, 632 aa, Homo sapiens
MSSKNSESGTATTGTSLSAPDITVRNVVNIARPSSQQSSWTSANNDVIVTGIYSPASSSSRQGTNKHTDTQITEAHKIPIQKTATKNDTEFQLHIPVQRQVAHCKNASLLLGEKTIILSRQTSVLNAGNSVFNHAKKNYGNSSVQASEMTVPQKPSVCHRPCKIEPVGIQRSYKPEHTGPALHNLCGQKPTIRDPYCRTQNLEIREVFSLAVSDYPQRILGGNAPQKPSSAEGNCLSIAMETGDAEDEYAREEELASMRAQIPSYSRFYESGSSLRAENQSTTLPGPGRNMPNSQMVNIRDMSDNVLYQNRNYHLTPRTSLHTASSTMYSNTNPLRSNFSPHFASSNQLRLSQNQNNYQISGNLTVPWITGCSRKRALQDRTQFSDRDLATLKKYWDNGMTSLGSVCREKIEAVATELNVDCEIVRTWIGNRRRKYRLMGIEVPPPRGGPADFSEQPESGSLSALTPGEEAGPEVGEDNDRNDEVSICLSEGSSQEEPNEVVPNDARAHKEEDHHAVTTDNVKIEIIDDEESDMISNSEVEQVNSFLDYKNEEVKFIENELEIQKQKYFKLQTFVRSLILAMKADDKEQQQALLSDLPPELEEMDFNHASLEPDDTSFSVSSLSEKNVSESL

SEQ ID NO: 1941 - protein, 130 aa, Homo sapiens
MLPGPSLLLSASHCRAPPVTGVLPSPGVTEVNKSLVSRDPLPVETHPASSSSPRGRLLRKAGLDCSSCRTRFPPLRSCRLSGAHTWVCSGFSRQLFKAAGRWKFEASPAPATALRTARGHPLRNTRGFLP

SEQ ID NO: 1942 - protein, 107 aa, Homo sapiens [sequence omitted]

SEQ ID NO: 1943 - protein, 360 aa, Homo sapiens
MIGHNVEGPFSKAFRDQMYIIEMPLSEAPLCISCCPVKGDLLVGCTNKLVLFSLKYQIINEEFSLLDFERSLIIHIDNITPVEVSFCVGYVAVMSDLEVLIVKLESGPKNGERVHHHPHKTNNRIRRTEEGISNEISQLESDDFVICQKPLELLGEKSEQSGLSVTLESTGLADEKRKYSHFQHLLYRRFAPDISSYVLSDDIKLHSLQLLPIYQTGSLTSDGKNLSQEKELLSLFCFFSLPHVGYLYMVVKSVELMSVYQYPEKSQQAVLTPQFLHVITSNNLQCFTVRCSAAAAREEDPYMDTTLKACPPVSMDVCALRIQLFIGLKAICHFKNHIILLTKAEPEAIPERRQSPKRLL

SEQ ID NO: 1944 - protein, 224 aa, Homo sapiens
MKTPRTMHTSVMALDRLFVIGGKTRGSRDIKSLLDVESYNPLSKEWISVSPLPRGIYYPEASTCQNVIYVLGSEVEITDAFNPSLDCFFKYNATTDQWSELVAEFGQFFHATLIKAVPVNCTLYICDLSTYKVYSFCPDTCVWKGEGSFECAGFNAGAIGIEDKIYILGGDYAPDEITDEVQVYHSNRSEWEEVSPMPRALTEFYCQVIQFNKYRDPWFSNLCA

SEQ ID NO: 1945 - protein, 126 aa, Homo sapiens
MEGLAVPRAGHSPTCIALPGLFSWREVPFLYPSEFFFLPPVSSLPFTMGLMMEITVILYLQTEPSKSSELHSYGKFSFFLFFFFEMEFRSCCPGWSAMAQSRLTATSTSQVQEFLLPQQEDYCNPK

SEQ ID NO: 1946 - protein, 711 aa, Homo sapiens
MCETMGYFFHAVYFPIDVENQYLTVRKWEIEKSSLVILFIHLTLPSLLLEDCEEAFLKNPEGKPRLIFHRLEDGKVSSDSVQQLIDQVSNLNKTSKAKIIDHSGDPAEGVYKTYICVEKIIKQDILGFENTDLETKDLGSEDSIPEEDDFGDVLWDIHDEQEQMETFQQASNSAHELGFEKYYQRLNDLVAAPAPIPPLLVSGGPGSGKSLLLSKWIQLQQKNSPNTLILSHFVGRPMSTSSESSLIIKRLTLKLMQHSWSVSALTLDPAKLLEEFPRWLEKLSARHQGSIIIVIDSIDQVQQVEKHMKWLIDPLPVNVRVIVSVNVETCPPAWRLWPTLHLDPLSPKDAKSIIIAECHSVDIKLSKEQEKKLERHCRSATTCNALYVTLFGKMIARAGRAGNLDKILHQCFQCQDTLSLYRLVLHSIRESMANDVDKELMKQILCLVNVSHNGVSESELMELYPEMSWTFLTSLIHSLYKMCLLTYGCGLLRFQHLQAWETVRLEYLEGPTVTSSYRQKLINYFTLQLSQDRVTWRSADELPWLFQQQGSKQKLHDCLLNLFVSQNLYKRGHFAELLSYWQFVGKDKSAMATEYFDSLKQYEKNCEGEDNMSCLADLYETLGRFLKDLGLLSQAIVPLQRSLEIRETALDPDHPRVAQSLHQLASVYVQWKKFGNAEQLYKQALEISENAYGADHPYTARELEALATLYQ

SEQ ID NO: 1947 - protein, 111 aa, Homo sapiens
MVSRQGPSVTTGGGRGDERALSDTLETARRPLPDVGPSILDFPASLQNWKLPRLCPLPLTLLKEDKEDNDKWRLQQSNTNSQLDAQERTLCLFLMVSSALHILRNFSGNKL

SEQ ID NO: 1948 - protein, 110 aa, Homo sapiens
MSVILLTPDELTNSSETRLSLEDLFRKDFVLHDPEARWINDTDVVYKSENGHVIKLNIETNATTLLLENTTFVTFKASRHSVSPDLKYVLLAYDVKQESNGDRVAYPRAV

SEQ ID NO: 1949 - protein, 213 aa, Homo sapiens
MVTQFKEKNESLQYETSSPTVQLKIPQLRVSSVSKSQPDGSGLLDVMYQVSKTSSVLEGSALQKLKNILPKQNKIECSGPVTHSSVDSYFLHGDLSPLCLNSKNGTVDGTSENTEDGLDRKDSKQPRKKRGRYRQYDHEIMEEAIAMVMSGKMSVSKAQGIYGVPHSTLEYKVKERSGTLKTPPKKKLRLPDTGLYNMTDSGTGSCKNSSKPV

SEQ ID NO: 1950 - protein, 373 aa, Homo sapiens
MASKPEKRVASSVFITLAPPRRDVAVAEEVRQAVCEARRGRPWEAPAPMKTPEAGLAGRPSPWTTPGRAAATVPAAPMQLFNGGCPPPPPVLDGEDVLPDLDLLPPPPPPPPVLLPSEEEAPAPMGASLIADLEQLHLSPPPPPPQAPAEGPSVQPGPLRPMEEELPPPPAEPVEKGASTDICAFCHKTVFPRELAVEAMKRQYHAQCFTCRTCRRQLAGQSFYQKDGRPLCEPCYQDTLERCGKCGEVVRDHIIRALGQAFHPSCFTCVTCARCIGDESFALGSQNEVYCLDDFYRKFAPVCSICENPIIPRDGKDAFKIECMGRNFHENCYRCEDCRILLSVEPTDQGCYPLNNHLFCKPCHVKRSAAGCC

SEQ ID NO: 1951 - protein, 129 aa, Homo sapiens [sequence omitted]

SEQ ID NO: 1952 - protein, 371 aa, Homo sapiens
MDMAQEPVTFRDVAIYFSREEWACLEPSQRALYRDVMLDNFSSVAALGFCSPRPDLVSRLEQWEEPWVEDRERPEFQAVQRGPRPGARKSADPKRPCDHPAWAHKKTHVRRERAREGSSFRKGFRLDTDDGQLPRAAPERTDAKPTAFPCQVLTQRCGRRPGRRERRKQRAVELSFICGTCGKALSCHSRLFAHQTVHTGTKAFECPECGQTFRWASNLQRHQKNHTREKPFCCEACGQAFSLKDRLAQHRKVHTEHRPYSCGDCGKAFKQKSNLLRHQLVHTGERPFYCADCGKAFRTKENLSHHQRVHSGEKPYTCAECGKSFRWPKGFSIHRRLHLTKRFYECGHCGKGFRHLGFFTRHQRTHRHGEV

SEQ ID NO: 1953 - protein, 546 aa, Homo sapiens
MDPKAGGGGEEDDCVDSGAETGGSDYSHLSSTSSELSVEEAQDPFLVSIHIIADPGESQPLQEAIDNVLAWIHPDLPLFRVSERRASRRRRKPPKGAQPALAVVLFLQEEYGEEQILQLHRTLQQPPWRHHHTEQVHGRFLPYLPCSQDFFTLAPGTPLWAIRPVHYGKEIVRFTVYCRYDNYADSLRFYQLILRRSPSQKKADFCIFPIFSNLDVDIQFSLKRLPCDQCPVPTDSSVLEFRVRDIGELVPLLPNPCSPISEGRWQTEDHDRNKILLQAQRVHKKFPKPGRVHHASEKKRHSTPLPSTAVPSHTPGSSQQSPLNSPHPGPIRTGLPPGHQQEFAGRANSTPNPPWSFQRSKSLFCLPTGGPSLASSAEPQWFSNTGAPGHRASEWRHGHLLSIDDLEGAQETDVDTGLRLSSSDLSVVSAYSAPSRFCSTVETPLPSERCSSHWAAHKDSREGPLPTVSRVTTEASWASLPFFTKRSSSSSATARAAPPAPSTSTLTDSSPQLPCDTPKVKQTDGDMPPPPGSAGPGDNDMEEFYI

SEQ ID NO: 1954 - protein, 136 aa, Homo sapiens
MGGSRSLTAADEYLTPSSICVAVGAGTEALDASTWKPGLFSLDGRKEAGGRRAEVLVPPALLGSEDMALPRLCLALAIGSELLLLLCGYEGRSGIMSSRPAPPSDVRAVHSDTSSESFWGLDGWTDGQINSILHLE

SEQ ID NO: 1955 - protein, 603 aa, Homo sapiens
MEKTKESETRCKMEAENSYTENAGKYLLEPISEKQYLAAEQLLDSHQLLDKRPKSESISLSDNEEMCKTWNTEYNTYDTISSKNHCKKNTTILLNGQSNAKMIHSGKHNLTYSRTYCCWKTKMSSCSQDHRSLVLQNDMKRMSQNQAVKRGYNSVMNESERFYRKRRQHSHSYSSDESLNRQNHLPEEFLRPPSTSVAPCKPKKKRRRKRGRFHPGFETLELKENTDYPVKDNSSLNPLDRLISEDKKEKMKPQEVAKIERNSEQTNQLRNKLSFHPNNLLPSETNGETEHLEMETTSGELSDVSNDPTTSVCVASAPTKEAIDNTLLEHKERSENINLNEKQIPFQVPNIERNFRQSQPKSYLCHYELAEALPQGKMNETPTEWLRYNSGILNTQPPLPFKEAHVSGHTFVTAEQILAPLALPEQALLIPLENHDKFKNVPCEVYQHILQPNMLANKVKFTFPPAALPPPSTPVQPLPLQQSLCSTSVTTIHHTVLQQHAAAAAAAAAAAAAGTFKVLQPHQQFLSQIPALTRTSLPQLSVGPVGPRLCPGNQPTFVAPPQMPIIPASVLHPSHLAFPSLPHALFPSLLSPHPTVIPLQPLF

SEQ ID NO: 1956 - protein, 314 aa, Homo sapiens
MGLLDSEPGSVLNVVSTALNDTVEFYRWTWSIADKRVENWPLMQSPWPTLSISTLYLLFVWLGPKWMKDREPFQMRLVLIIYNFGMVLLNLFIFRELFMGSYNAGYSYICQSVDYSNNVHEVRIAAALWWYFVSKGVEYLDTVFFILRKKNNQVSFLHVYHHCTMFTLWWIGIKWVAGGQAFFGAQLNSFIHVIMYSYYGLTAFGPWIQKYLWWKRYLTMLQLIQFHVTIGHTALSLYTDCPFPKWMHWALIAYAISFIFLFLNFYIRTYKEPKKPKAGKTAMNGISANGVSKSEKQLMIENGKKQKNGKAKGD

SEQ ID NO: 1957 - protein, 145 aa, Homo sapiens
MKITRQKHAKKHLGFFRNNFGVREPYQILLDGTFCQAALRGRIQLREQLPRYLMGETQLCTTRCVLKELETLGKDLYGAKLIAQKCQVRNCPHFKNAVSGSECLLSMVEEGNPHHYFVATQYIPRMYTFCTNYGGQQYVIDALIG

SEQ ID NO: 1958 - protein, 120 aa, Homo sapiens [sequence omitted]

SEQ ID NO: 1959 - protein, 153 aa, Homo sapiens
MSSCKGRLRNGPESSAVTIQKDQRKVSAHSSPKRVVEQLLPWKDLQNGIALWSVVPRSKWKIKALIFVKSLPSQSPPRIYILILGLTQFLQEFFFYLPKLDTHRHLGYELLTAFLGDLLAVPQVNMTDVSTAFEEGQALISDLIAVCREEIVM

SEQ ID NO: 1960 - protein, 346 aa, Homo sapiens
MYLSLWVTINTVNLRNTLSGLRGAVTTVGMIKSDVPGTQEWLDERRRQGDLPLPTNSNPVLSLELCDPGQGPAPFQAVVVLIQPGRGLALRPPPSCLFPPDPTPSPPAGQIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGTFASQVTLEGDKLKVEREIDGGLETLRLKLPAVVTADLRLNEPRYATLPNIMKAKKKKIEVIKPGDLGVDLTSKLSVISVEDPPQRTAGVKVETTEDLVAKLKEIGRI

SEQ ID NO: 1961 - protein, 502 aa, Homo sapiens
MGTENKEVIPKEEISEESEPHGSLLEKFPKVVYQGHEFGAGCEEDMLEGHSRESMEEVIEQMSPQERDFPSGLMIFKKSPSSEKDRENNESERGCSPSPNLVTHQGDTTEGVSAFATSGQNFLEILESNKTQRSSVGEKPHTCKECGKAFNQNSHLIQHMRVHSGEKPFECKECGKTFGTNSSLRRHLRIHAGEKPFACNECGKAFIQSSHLIHHHRIHTGERPYKCEECGKAFSQNSALILHQRIHTGEKPYECNECGKTFRVSSQLIQHQRIHTEERYHECNECGKAFKHSSGLIRHQKIHTGEKPYLCNECGKGFGQSSELIRHQRIHTGDKPYECNECGKTFGQNSEIIRHIRIHTGEKPYVCKECGKAFRGNSELLRHERIHTGEKPYECFECGKAFRRTSHLIVHQRIHTGEKPHQCNECARTFWDNSELLLHQKIHIGEKPYECSECEKTFSQHSQLIIHQRIHTGEKPYECQECQKTFSRSSHLLRHQSVHCME

SEQ ID NO: 1962 - protein, 346 aa, Homo sapiens
MDDSSILRRRGLQKELSLPRRGSFCRTSNRKSLIVTSSTSPTLPRPHSPLHGHTGNSPLDSPRNFSPNAPAHFSFVPARSHSHRADRTDGRRWSLASLPSSGYGTNTPSSTVSSSCSSQEKLHQLPFQPTADELHFLTKHFSTESVPDEEGRQSPAMQPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLTPIHLMRIPARAGYGSLSVHKQ

SEQ ID NO: 1963 - protein, 620 aa, Homo sapiens
MPSERCLSIQEMLTGQRLCHSESHNDSVLAALNQQRSDGILCDITLIAEEQKFHAHKAVLAACSDYFRAMFSLCMVESGADEVNLHGVTSLGLKQALEFAYTGQILLEPGVIQDVLAAGSHLQLLELLNLCSHYLIQELNSFNYLDLYRLADLFNLTLLEKAVIDFLVKHLSELLKSRPEEVLTLPYCLLQEVLKSDRLTSLSEEQIWQLAVRWLEHNCHYQYMDELLQYIRFGLMDVDTLHTVALSHPLVQASETATALVNEALEYHQSIYAQPVWQTRRTKPRFQSDTLYIIGGKKREVCKVKELRYFNPVDQENALIAAIANWSELASMPVGRSHHCVAVMGDFLFVAGGEVEHASGRTCAVRTACRYDPRSNSWAEIAPMKNCREHFVLGAMEEYLYAVGGRNELRQVLPTVERYCPKKNKWTFVQSFDRSLSCHAGYVADGLLWISGGVTNTAQYQNRLMVYEPNQNKWISRSPMLQRRVYHSMAAVQRKLYVLGGNDLDYNNDRILVRHIDSYNIDTDQWTRCNFNLLTGQNESGVAVHNGRIYLVGGYSIWTNEPLACIQVLDVSREGKEEVFYGPTLPFASNGIAACFLPAPYFTCPNLQTLQVPHHRIGTI

SEQ ID NO: 1964 - protein, 619 aa, Homo sapiens [sequence omitted]

SEQ ID NO: 1965 - protein, 106 aa, Homo sapiens
MMRRDMWAVTCCLASWRNCLSVGWFLYTLGQRANIGGLREPWYVVEKDSVKGDVFVAPRTDHPALYRDLLRTSRVHWIAEEPPAALVRDKMMECHFRFRHQMALGD

SEQ ID NO: 1966 - protein, 192 aa, Homo sapiens
MVSSGHVPQEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLCKEELEPKWPTPEKLWDWDMWMRMPEQRRGRECIIPDVSRSYHFGIVGLNMNGYFHVSGRQGAGHSVA

SEQ ID NO: 1967 - protein, 125 aa, Homo sapiens
MGQMKSPYLSPTGHGLNVCRELEPGEGSCGLGSAEFIMSKCTVLGWARFPAPRPATASQDLPLAPLPHRQSACPLLSGTSWSLPNLKFKLCNCTKLQAWQLWDPGFRDSRFLGLPQEGPAEVKWA

SEQ ID NO: 1968 - protein, 688 aa, Homo sapiens
MGNPENIEDAYVAVIRPKNTASLNSREYRAKSYEILLHEVPIEGQKKKRKKVLLETKLQGNSEITQGILDYVVETTKPISPANQGIRGKRVVLMKKFPLDGEKMGREASLFIVPSVVKDNTKYTYTPGCPIFYCLQDIMRVCSESSTHFATLTARMLIALDKWLDERHAQSHFIPALFRPSPLERIKTNVINPAYATESGQTENSLHMGYSALEIKSKMLALEKADTCIYNPLFGSDLQYTNRVDKVVINPYFGLGAPDYSKIQIPKQEKWQRSMSSVTEDKYGKVEATRILLEKGKCNPNLLNGQLSSPLHFAAGGGHAEIVQILLNHPETDRHITDQQGRSPLNICEENKQNNWEEAAKLLKEAINKPYEKVRIYRMDGSYRSVELKHGNNTTVQQIMEGMRLSQETQQYFTIWICSENLSLQLKPYHKPLQHVRDWPEILAELTNLDPQRETPQLFLRRDVRLPLEVEKQIEDPLAILILFDEARYNLLKGFYTAPDAKLITLASLLLQIVYGNYESKKHKQGFLNEENLKSIVPVTKLKSKAPHWTNRILHEYKNLSTSEGVSKEMHHLQRMFLQNCWEIPTYGAAFFTGQIFTKASPSNHKVIPVYVGVNIKGLHLLNMETKALLISLKYGCFMWQLGDTDTCFQIHSMENKMSFIVHTKQAGLVVKLLMKLNGQLMPTERNS

SEQ ID NO: 1969 - protein, 139 aa, Homo sapiens [sequence omitted]

SEQ ID NO: 1970 - protein, 109 aa, Homo sapiens
MLRAAREKNQVTYKGKPIRLTVDLSAETLQARREWGPIFNILKEKNFQSRILFPAKLSFISKGEIKPFQKKKMLRDFVTIIPALQELLKEALNMERKDKYQPLQKHSKI

SEQ ID NO: 1971 - protein, 435 aa, Homo sapiens
MTEPQNSQGRYKGIYMEEKLYRRAQHDDSLSWTSCDHHESQECKGEDPGRHPSCGKNLGMKSTVEKRNAAHVLPQPFPCNNCGVAFADDTDPHVHHSTHLGEKSYKCDQYGKNFSQSQDLIVHCKTHSGKTPYEFHEWPMGCKQSSDLPRYQKVSSGDKPYKCKECGKGFRRSSSLHNHHRVHTGEMPYKCDECGKGFGFRSLLCIHQGVHTGKKPYKCEECGKGFDQSSNLLVHQRVHTGEKPYKCSECGKCFSSSSVLQVHWRFHTGEKPYRCGECGKGFSQCTHLHIHQRVHTGEKPYKCNVCGKDFAYSSVLHTHQRVHTGEKPYKCEVCGKCFSYSSYFHLHQRDHIREKPYKCDECGKGFSRNSDLNVHLRVHTGERPYKCKACGKGFSRNSYLLAHQRVHIDETQYTHCERGKDLLTHQRLHEQRETL

SEQ ID NO: 1972 - protein, 519 aa, Homo sapiens
MYLREPQNYQSRCQQIDVKNKLCKCDHCVRQRIAHQHDDHGVHKREKAFSHNNCGKDCVKESSQHSIIQSGEQTSDENGKGLSVGSNLELHQQLHLRDKPHVNVEYGKGIGYSSGLPRHQCFHIGEKCYRNGDSGEGFSQGSHLQPHQRVSTGENLYRCQVYARSSNQNSCLPSHELTHPGEKLCTCGRCGKGFHHSLDFDIHCVDSAGERACKCDVYDKGFSQTSQLQAHQRGHSRDKTYKWEVSDRIFNRNSGLHQRVHTGEKPYKCEVCDKGFSKASNLQAHQRIHTGEKPYKCDVCDKNFSRNSHLQAHQRVHTGEKPYKCDTCGKDFSQISHLQAHQRVHTGEKPYKCETCGKGFSQSSHLQDHQQVHTGENPYKCGVCGKGFSWSSHLQAHQRVHTGEKPYKCEECRKGFIWNSYLHVHQRIHTGVKPYKCGMCGKSFSQTSHLQAHQRVHTGEKPYKCFVCGKGFSKSSYLQIHQRVHDGDESINHDECDRGALQDLDFPFSSENPHSTEYL

SEQ ID NO: 1973 - protein, 142 aa, Homo sapiens
MWALMPRRFVTWPLKLCNISPGLPGGTRGTSVLPPCCLWIRALRPATWLCLEGMECDVGGWRRRLEVAVGVKGEACSECSSECVCTEAQAVVLEAVAGLCLRACAGSLWWVRGWSVSSSPVPRQGSILGATRQWRELSLCPA

SEQ ID NO: 1974 - protein, 552 aa, Homo sapiens
MVSLQLALSPQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDLEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 1975 - protein, 109 aa, Homo sapiens
MHTYAGLAVICALIGFSSGYFSLMPVVTEDLVGIEHLANAYGIIICANGISALLGPPFAGWIYDITQKYDFSFYICGLLYMIGILFLLIQPCIRIIEQSRRKYMDGAHV

SEQ ID NO: 1976 - protein, 516 aa, Homo sapiens
MHGRKDDAQKQPVKNQLGLNPQSHLPELQLFQAEGKIYKYDHMEKSVNSSSLVSPPQRISSTVKTHISHTYECNFVDSLFTQKEKANIGTEHYKCNERGKAFHQGLHFTIHQIIHTKETQFKCDICGKIFNKKSNLASHQRIHTGEKPYKCNECGKVFHNMSHLAQHRRIHTGEKPYKCNECGKVFNQISHLAQHQRIHTGEKPYKCNECGKVFHQISHLAQHRTIHTGEKPYECNKCGKVFSRNSYLVQHLIIHTGEKPYRCNVCGKVFHHISHLAQHQRIHTGEKPYKCNECGKVFSHKSSLVNHWRIHTGEKPYKCNECGKVFSHKSSLVNHWRIHTGEKPYKCNECGKVFSRNSYLAQHLIIHAGEKPYKCDECDKAFSQNSHLVQHHRIHTGEKPSKCDECGKVFSQNSYLAYHWRIHTGEKAYKCNECGKVFGLNSSLAHHRKIHTGEKPFKCNECGKAFSMRSSLTNHHAIHTGEKHFKCNECGKLFRDNSYLVRHQRFHAGKKSNTCN

SEQ ID NO: 1977 - protein, 169 aa, Homo sapiens [sequence omitted]

SEQ ID NO: 1978 - protein, 399 aa, Homo sapiens
MAVTMLQDWCRWMGVNARRGLLILGIPEDCDDAEFQESLEAALRPMGHFTVLGKAFREEDNATAALVELDREVNYALVPREIPGTGGPWNVVFVPRCSGEEFLGLGRVFHFPEQEGQMVESVAGALGVGLRRVCWLRSIGQAVQPWVEAVRCQSLGVFSGRDQPAPGEESFEVWLDHTTEMLHVWQGVSERERRRRLLEGLRGTALQLVHALLAENPARTAQDCLAALAQVFGDNESQATIRVKCLTAQQQSGERLSAFVLRLEVLLQKAMEKEALARASADRVRLRQMLTRAHLTEPLDEALRKLRMAGRSPSFLEMLGLVRESEAWEASLARSVRAQTQEGAGARAGAQAVARASTKVEAVPGGPGREPEGLLQAGGQEAEELLQEGLKPVLEECDN

SEQ ID NO: 1979 - protein, 193 aa, Homo sapiens
MQLVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLALAGFIYACYVVKCITEEEDSFDFIGGFDSYGYQGPQKTSHLQLQPMYMSK

SEQ ID NO: 1980 - protein, 245 aa, Homo sapiens [sequence omitted]

SEQ ID NO: 1981 - protein, 133 aa, Homo sapiens [sequence omitted]

SEQ ID NO: 1982 - protein, 175 aa, Homo sapiens
MLRFMVKEIVRDLGEAGSSLAGTPGPRTDWQGPGIVGRSGQVLREPQPGCGLTHSRLADQDGDKQLSVPEFISLPVGTVENQQGQDIDDNWVKDRKKEFEELIDSNHDGIVTAEELESYMDPMNEYNALNEAKQMIAVADENQNHHLEPEEVLKYSEFFTGSKLVDYARSVHEEF

SEQ ID NO: 1983 - protein, 363 aa, Homo sapiens
MSKLWRRGSTSGAMEAPEPGEALELSLAGAHGHGVHKKKHKKHKKKHKKKHHQEEDAGPTQPSPAKPQLKLKIKLGGQVLGTKSVPTFTVIPEGPRSPSPLMVVDNEEEPMEGVPLEQYRAWLDEDSNLSPSPLRDLSGGLGGQEEEEEQRWLDALEKGELDDNGDLKKEINERLLTARQRALLQKARSQPSPMLPLPVAEGCPPPALTEEMLLKREERARKRRLQAARRAEEHKNQTIERLTKTAATSGRGGRGGARGERRGGRAAAPAPMVRYCSGAQGSTLSFPPGVPAPTAVSQRPSPSGPPPRCSVPGCPHPRRYACSRTGQALCSLQCYRINLQMRLGGPEGPGSPLLATFESCAQE

SEQ ID NO: 1984 - protein, 323 aa, Homo sapiens [sequence omitted]

SEQ ID NO: 1985 - protein, 100 aa, Homo sapiens
MPILPQSEQSSLFGHNYSGKGFSQCHSHAHRTSILLGLFADGTSHRPSILLYPYGLLKCTQDTWLYKESVLHQTPAPLNCLLPQRVPLSLSHRPKPKPYP

SEQ ID NO: 1986 - protein, 140 aa, Homo sapiens
MRRERPELRDAEGRLRLRAGCLVTAWPRAPSGAGSWSMAAASPWPASWGFPDASSTVPSLCTEARAGRGGPATARSRVSADSQGGRAGSSSPSSALRLCCAGPSQAHPGPSPAVLPGRCGLLGSFPRPPAPQGRWGPSLG

SEQ ID NO: 1987 - protein, 204 aa, Homo sapiens [sequence omitted]

SEQ ID NO: 1988 - protein, 100 aa, Homo sapiens [sequence omitted]

SEQ ID NO: 1989 - protein, 163 aa, Homo sapiens [sequence omitted]

SEQ ID NO: 1990 - protein, 105 aa, Homo sapiens
MQAICTLELHAVKTPNGVELSLNLKSRRMHKGTGPGPTSGHPPAGCRASLGAKARPVEPELCVARALCSSCTYYAPPPFSHHSSSSAILIYTDCTPPAQTTMSLL

SEQ ID NO: 1991 - protein, 221 aa, Homo sapiens
MAKLIAQDLQPMLEAPGRRPRQDSEGSDTEPLDEDSPGVYENGLTPSEGSPELPSSPASSRQPWRPPACRSPLPPGGDQGPFSSPKAWPEEWGGAGAQAEELAGYEAEDEAGMQGPGPRDGSPLLGGCSDSSGSLREEEGEDEEPLPPLRAPAGTEPEPIAMLVLRGSSSRGPDAGCLTEELGEPAATERPAQPGAANPLVVGAVALLDLSLAFLFSQLLT

SEQ ID NO: 1992 - protein, 372 aa, Homo sapiens
MNHCQLPVVIDNGSGMIKAGVAGCREPQFIYPNIIGRAKGQSRAAQGGLELCVGDQAQDWRSSLFISYPVERGLITSWEDMEIMWKHIYDYNLKLKPCDGPVLITEPALNPLANRQQITEMFFEHLGVPAFYMSIQAVLALFAAGFTTGLVLNSGAGVTQSVPIFEGYCLPHGVQQLDLAGLDLTNYLMVLMKNHGIMLLSASDRKIVEDIKESFCYVAMNYEEEMAKKPDCLEKVYQLPDGKVIQLHDQLFSCPEALFSPCHMNLEAPGIDKICFSSIMKRDTGLRNSFFSNIILAGGSTSFPGLDKRLVKDIAKVAPANTAVQVIAPPERKISVWMGGSILASLSAFQDMWITAAEFKEVGPNIVHQRCF

SEQ ID NO: 1993 - protein, 131 aa, Homo sapiens
MSGTLRLVPASSLRAAPKQFPAFLGAETYSLQDSLFTCTFSRFPNSKSLKGTLATFLSPSPSLDGMAHVSLITQALAISAEPPELNEDLLLTEKGVTVLPQQVLFPTTNLLSHLGFGSTMQQLLCIQILDG

SEQ ID NO: 1994 - protein, 110 aa, Homo sapiens
MCCRAEPSWRSFARAEQKGNVGLEFPHRVPTRAMPSRAVRRGPPSSRLQNGRSTNSLHCVPGKVTDTQHQPTKAARSGAVPCKAMGQSCPRPWKPTSCISVAGNRSQDWP

SEQ ID NO: 1995 - protein, 536 aa, Homo sapiens
MAVGLLKAMYQELVTFRDVAVDFSQEEWDCLDSSQRHLYSNVMLENYRILVSLGLCFSKPSVILLLEQGKAPWMVKRELTKGLCSGWEPICETEELTPKQDFYEEHQSQKIIETLTSYNLEYSSLREEWKCEGYFERQPGNQKACFKEEIITHEEPLFDEREQEYKSWGSFHQNPLLCTQKIIPKEEKVHKHDTQKRSFKKNLMAIKPKSVCAEKKLLKCNDCEKVFSQSSSLTLHQRIHTGEKPYKCIECGKAFSQRSNLVQHQRIHTGEKPYECKECRKAFSQNAHLVQHLRVHTGEKPYECKVCRKAFSQFAYLAQHQRVHTGEKPYECIECGKAFSNRSSIAQHQRVHTGEKPYECNVCGKAFSLRAYLTVHQRIHTGERPYECKECGKAFSQNSHLAQHQRIHTGEKPYKCQECRKAFSQIAYLAQHQRVHTGEKPYECIECGKAFSNDSSLTQHQRVHTGEKPYECTVCGKAFSYCGSLAQHQRIHTGERPYECKECKKTFRQHAHLAHHQRIHIGESLSPPNPVNHQVL

SEQ ID NO: 1996 - protein, 336 aa, Homo sapiens
MTVLLKYLCAEYGWRNAMLIQGAVSLNLCVCGALTRPLSPGKNPNDPGEKDVRGLPAHSTESVKSTGQQGRTEEKDGGLGNEETLCDLQAQECPDQAGHRKNMCALRILKTVSWLTMRVRKGFEDWYSGYFGTASLFTNRMFVAFIFWALFAYSSFVIPFIHLPEIVNLYNLSEQNDVFPLTSIIAIVHIFGKVILGVIADLPCISVWNVFLLANFTLVLSIFILPLMHTYAGLAVICALIGFSSGYFSLMPVVTEDLVGIEHLANAYGIIICANGISALLGPPFAGWIYDITQKYDFSFYICGLLYMIGILFLLIQPCIRIIEQSRRKYMDGAHV

SEQ ID NO: 1997 - protein, 175 aa, Homo sapiens
MPSTGFQGFLLSLGLNSDPFPCFPLHLAEFRPHFIFFFRPWGSLPTVFPCHSVQVHKLLIVVELLLGEIPDRLQFRQPSLKRSLMPYFLLTQAVRTGNLAKFNQVLDQFGEKFQADGTYTLIIRLRHNVIKTGVRMISLSYSRISLADIAQKLQLDSPEDAEFIVAKVGLVQEPQ

SEQ ID NO: 1998 - protein, 127 aa, Homo sapiens
MPSPLGPPCLPVMDPETTLEEPETARLRFRGFCYQEVAGPREALARLRELCCQWLQPEAHSKEPFCHRGVPQLHATAPPAAGTAPELASCLSRPPALLQSPAWWGRPGPVARGQQGRPALRFRLLRS

SEQ ID NO: 1999 - protein, 101 aa, Homo sapiens
MVRHKSEDSLEGQELCLFVHIPRVCHEVWPTWAVTRPLCITVAAMVDGGWTEPVVIGSLSGGLTREGSQGGHLLSPSCACHCTVLLPSLNSTHTASLVSGV

SEQ ID NO: 2000 - protein, 101 aa, Homo sapiens [sequence omitted]

SEQ ID NO: 2001 - protein, 719 aa, Homo sapiens
MEKILFYLFLIGIAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRMIPPTSKTFLVNNLAAGTMYDLCVLAIYDDGITSLTATRVVGCIQFTTEQDYVRCHFMQSQFLGGTMIIIIGGIIVASVLVFIIILMIRYKVCNNNGQHKVTKVSNVYSQTNGAQIQGCSVTLPQSVSKQAVGHEENAQCCKATSDNVIQSSETCSSQDSSTTTSALPPSWTSSTSVSQKQKRKTGTKPSTEPQNEAVTNVESQNTNRNNSTALQLVSRPPDSVTEGPTSKRAHIKPNALLTNVDQIVQETQRLELI

SEQ ID NO: 2002 - protein, 168 aa, Homo sapiens
MAEGSRIPQARALLQQCLHARLQIRPADGDVAAQWVEVQRGLVIYVCFFKGADKELLPKMVNTLLNVKLSETENGKHVSILDLPGNILIIPQATLGGRLKGRNMQYHSNSGKEEGFELYSQFVTLCEKEVAANSKCAEARVVVEHGTYGNRQVLKLDTNGPFTHLIEF

SEQ ID NO: 2003 - protein, 107 aa, Homo sapiens [sequence omitted]

SEQ ID NO: 2004 - protein, 105 aa, Homo sapiens
MPSVTGNANALVMILTECLQSLNRMHTIQNMPLLCNFGSISMIQKGGSKNRSILDCHRSLWTLPPGNQALSAVFLPWVAHIWEHICSVVLEVNFWRLLYLQRDHS

SEQ ID NO: 2005 - protein, 912 aa, Homo sapiens
MIIAGMKLLRTSFCNPVYQFINLSFTVIFFHFDYKDISESFLLDFFMVSILFSKLGDLLHKLQFVLTYVAPWQMAWGSSFHVFAQLFAIPHSAMLFFQTIATSIFSTPLSPFLGSVIFITSYVRPVKFWEKNYNTRRVDNSNTRLAVQIERDPGNDDNNLNSIFYEHLTRTLQESLCGDLVLGRWGNYSSGDCFILASDDLNAFVHLIEIGNGLVTFQLRGLEFRGTYCQQREVEAIMEGDEEDRGCCCCKPGHLPHLLSCNAAFHLRWLTWEITQTQYILEGYSILDNNAATMLQVFDLRRILIRYYIKSIIYYMVTSPKLLSWIKNESLLKSLQPFAKWHYIERDLAMFNINIDDDYVPCLQGITRASFCNVYLEWIQHCARKRQEPSTTLDSDEDSPLVTLSFALCTLGRRALGTAAHNMAISLDSFLYGLHVLFKGDFRITARDEWVFADMDLLHKVVAPAIRMSLKLHQDQFTCPDEYEDPAVLYEAIQSFEKKVVICHEGDPAWRGAVLSNKEELLTLRHVVDEGADEYKVIMLHRSFLSFKVIKVNKECVRGLWAGQQQELIFLRNRNPERGSIQNNKQVLRNLINSSCDQPLGYPMYVSPLTTSYLGTHRQLKNIWGGPITLDRIRTWFWTKWVRMRKDCNARQHSGGNIEDVDGGGAPTTGGNNAPSGGSQESSAEQPRKGGAQHGVSSCEGTQRTGRRKGRSQSVQAHSALSQRPPMLSSSGPILESRQTFLQTSTSVHELAQRLSGSRLSLHASATSLHSQPPPVTTTGHLSVRERAEALIRSSLGSSTSSTLSFLFGKRSFSSALVISGLSAAEGGNTSDTQSSSSVNIVMGPSARAASQATRHLSEPCEPPDATEQGQLHDRCLAEAVADTLGVVCRRASQEDMGLDDTASQQSVSDEQ

SEQ ID NO: 2006 - protein, 383 aa, Homo sapiens
MPSGCRCLHLVCLLCILGAPGQPVRADDCSSHCDLAHGCCAPDGSCRCDPGWEGLHCERCVRMPGCQHGTCHQPWQCICHSGWAGKFCDKDEHICTTQSPCQNGGQCMYDGGGEYHCVCLPGFHGRDCERKAGPCEQAGSPCRNGGQCQDDQGFALNFTCRCLVGFVGARCEVNVDDCLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPSLVALVVFGALTAALVLATVLLTLRAWRRGVCPPGPCCYPAPHYAPACQDQECQVSMLPAGLPLPRDLPPEPGKTTAL

SEQ ID NO: 2007 - protein, 115 aa, Homo sapiens [sequence omitted]

SEQ ID NO: 2008 - protein, 123 aa, Homo sapiens; identical to SEQ ID NO: 1937

SEQ ID NO: 2009 - protein, 175 aa, Homo sapiens
MATATNELGQATCAASLTVRPGGSTSPFSSPITSDEEYLSPPEEFPEPGETWPRTPTMKPSPSQNRRSSDTGSKAPPTFKVSLMDQSVREGQDVIMSIRVQGEPKPVVSWLRNRQPVRPDQRRFAEEAEGGLCRLRILAAERGDAGFYTCKAVNEYGARQCEARLEVRGEYLISP

SEQ ID NO: 2010 - protein, 802 aa, Homo sapiens [sequence omitted]

SEQ ID NO: 2011 - protein, 191 aa, Homo sapiens
MYVCLCVSVAKVTMADRAAAERACKDPNPIIDGRKANVNLAYLGAKPRIMQPGFAFGVQQLHPALIQRPFGIPAHYVYPQAFVQPGVVIPHVQPTAAAASTTPYIDYTGAAYAQYSAAAAAAAAAAAYDQYPYAASPAAAGYVTAGGYGYAVQQPITAAAPGTAAAAAAAAAAAAAFGQYQPQQLQTDRMQ

SEQ ID NO: 2012 - protein, 580 aa, Homo sapiens
MVLVGTQDAISAANPRVIDDSRARKLSTDLKRCTYYETCATYGLNVERVFQDVAQKVVALRKKQQLAIGPCKSLPNSPSHSAVSAASIPAVHINQATNGGGSAFSDYSSSVPSTPSISQRELRIETIAASSTPTPIRKQSKRRSNIFTSRKGADLDREKKAAECKVDSIGSGRAIPIKQGILLKRSGKSLNKEWKKKYVTLCDNGLLTYHPSLHDYMQNIHGKEIDLLRTTVKVPGKRLPRATPATAPGTSPRANGLSVERSNTQLGGGTEAEESFEFVVVSLTGQTWHFEASTAEERELWVQSVQAQILASLQGCRSAKDKTRLGNQNAALAVQAVRTVRGNSFCIDCDAPNPDWASLNLGALMCIECSGIHRHLGAHLSRVRSLDLDDWPPELLAVMTAMGNALANSVWEGALGGYSKPGPDACREEKERWIRAKYEQKLFLAPLPSSDVPLGQQLLRAVVEDDLRLLVMLLAHGSKEEVNETYGDGDGRTALHLSSAMANVVFTQLLIWYGVDVRSRDARGLTPLAYARRAGSQECADILIQHGCPGEGCGLAPTPNREPANGTNPSAELHRSPSLL

SEQ ID NO: 2013 - protein, 130 aa, Homo sapiens
MASDLIRTILVVALISKLGTAVDAELMPSGAILQNKRENLPRVCHALAFLGMARCQDLFLVRLQGWKLGTRFQDGPRSTPQEEGGSPQRKRGMPVQIHFLLKSFLSSPITFAFISLARTVSLATAICKIV

SEQ ID NO: 2014 - protein, 124 aa, Homo sapiens
MSSLQLCCVSLLPNLSDCERTLCLSHGQPLAGPLICPPSIVWMAISCWASLTVKSLYCLLGFWWEAVISSNELPLPWICQEADGNLANSGRYQAPSSAPVTLFYTCGSTTVCSEGQSLPLLCFS

SEQ ID NO: 2015 - protein, 158 aa, Homo sapiens
MEKGLRRTQQCGSATAGNHETETARWRQPDTKLGTQTPRFPPWPHPWAKSNSEPSSSSISFNPHRGCLLFTAVEVRVGVGGMLFSCRLSSWDEETSSLLGLAGPAKQMHTLTTAQGLRQVCSLSKTCPGFSKGKSIRKRMENLYSFILLPSNGHSPMY

SEQ ID NO: 2016 - protein, 632 aa, Homo sapiens
MAERRAFAQKISRTVAAEVRKQISGQYSGSPQLLKNLNIVGNISHHTTVPLTEAVDPVDLEDYLITHPLAVDSGPLRDLIEFPPDDIEVVYSPRDCRTLVSAVPEESEMDPHVRDCIRSYTEDWAIVIRKYHKLGTGFNPNTLDKQKERQKGLPKQVFESDEAPDGNSYQDDQDDLKRRSMSIDDTPRGSWACSIFDLKNSLPDALLPNLLDRTPNEEIDRQNDDQRKSNRHKELFALHPSPDEEEPIERLSVPDIPKEHFGQRLLVKCLSLKFEIEIEPIFASLALYDVKEKKKISENFYFDLNSEQMKGLLRPHVPPAAITTLARSAIFSITYPSQDVFLVIKLEKVLQQGDIGECAEPYMIFKEADATKNKEKLEKLKSQADQFCQRLGKYRMPFAWTAIHLMNIVSSAGSLERDSTEVEISTGERKGSWSERRNSSIVGRRSLERTTSGDDACNLTSFRPATLTVTNFFKQEGDRLSDEDLYKFLADMRRPSSVLRRLRPITAQLKIDISPAPENPHYCLTPELLQVKLYPDSRVRPTREILEFPARDVYVPNTTYRNLLYIYPQSLNFANRQGSARNITVKVQFMYGEDPSNAMPSPSCTHPIPTVRPLPLWCYHSIFSLLSWDFIT

SEQ ID NO: 2017 - protein, 207 aa, Homo sapiens [sequence omitted]

SEQ ID NO: 2018 - protein, 637 aa, Homo sapiens [sequence omitted]

SEQ ID NO: 2019 - protein, 306 aa, Homo sapiens
MDADSLLLSLELASGSGQGLSPDRRASLLTSLMLVKRDYRYDRVLFWGRILGLVADYYIAQGLSEDQLAPRKTLYSLNCTEWSLLPPATEEMVAQSSVVKGRFMGDPSYEYEHTELQKVNEGEKVFEEEIVIDKAVAIIPRGALFKTPFGPTHVNRTFEGLSLSEAKKLSSYFHFREPVELKNKTLLEKADLDPSLDFMDSLEHDIPKGSEAVVQGDFTWLLSRCGFGWPCSWDSCSVSMRVLEHPDGEGQCPGGAAQPALAGPHLLPCSPHQELWLRLRGHWREEHGLALHAIEWEPAWMFLNRV

SEQ ID NO: 2020 - protein, 105 aa, Homo sapiens
MYGEEFIFYDYNNPLDLPERIAAHSFDIVIADPPYLSEECLRKTSETVKYLTRGKILLCTGAIMEEQAAELLGVKMCTFVPRHTRNLANEFRCYVNYDSGLDCGI

SEQ ID NO: 2021 - protein, 113 aa, Homo sapiens [sequence omitted]

SEQ ID NO: 2022 - protein, 159 aa, Homo sapiens [sequence omitted]

SEQ ID NO: 2023 - protein, 224 aa, Homo sapiens
MEVLAKEDTEAAIQSILYKENSVIKGNAFIEHYDPKEYDPFYMSKKDPNFLKVTIPPFHDPLKKAQYDKDNEKRTLLQCETGKIYSIKEFKEVEKVQLHSRFPQISNSRHFITPNEWLKLPTRYIESEFCRRRRNKGSSFLEREPLCYQEGNNPSAKEAISEGYFSSLSLSQEREEDQDGSCSVSQLEWIQAWLASASTSRTQAILPPQLPEWLGLRVPATMPG

SEQ ID NO: 2024 - protein, 233 aa, Homo sapiens [sequence omitted]

SEQ ID NO: 2025 - protein, 121 aa, Homo sapiens [sequence omitted]

SEQ ID NO: 2026 - protein, 116 aa, Homo sapiens
MERSENSPMEAAQTLEQSCKMPGQSRYSARNGHCFHYSGDSTAKEEKYFIQEWTSRLRTEVRGEESWRIVFLKKANSQGGLLGPCLPTTEVHLGVLGPALSSLCHLSLFNALNSVK

SEQ ID NO: 2027 - protein, 168 aa, Homo sapiens
MDFSRVTGKGRREHKGKKKTPSSPSLGSLQQRDGAKAEVGDQVLVAGQKQGIVRFYGKTDFAPGYWYGIELDQPTGKHDGSVFGVRYFTCPPRHGVFAPASRIQRIGGSTDSPGDSVGAKKVHQVTMTQPKRTFTTVRTPKDIASENSISRLLFCCWFPWMLRAEMQS

SEQ ID NO: 2028 - protein, 139 aa, Homo sapiens
MSLTQMQGLLTPTHAFPPQPHRARRGHRRGEGLCPRLPISQLLTEAWFAQSSELQGPALVGMGWGAGSCPSPPSGSHLRMFTCQTECNTPPQALPSHCMASAHPAPVHPTPTPWKPLSMIRSGLGREVAITPLKSLWTF

SEQ ID NO: 2029 - protein, 270 aa, Homo sapiens
MKNDTRIHFQEDWKIITLFIGGNDLCDFCNDLVHYSPQNFTDNIGKALDILHAEVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTVRTLGPQVVWG

SEQ ID NO: 2030 - protein, 128 aa, Homo sapiens
MQHGTLGGSERASRAAPVGRLGRAPLARKVAASTVHGSQASVVWCGCGWGVDWICRLVPLSWRAVGVQAVLSGESHSTFESPHVFAPLWSRTCVSHTQWTCTCDMLVSVAAVSWVWNASDWSLAPGLP

SEQ ID NO: 2031 - protein, 113 aa, Homo sapiens
MLCEFLIDTGDNCLRFRNFQTTGKTFSVSPIQRQPWNRIPRGFWDPFPCSVRLCGHLLAGGGCFLGSVPRPAWSPGLSPWVKIQRCPVRILPTGQLRNTSISQDIRGSSKRAY

SEQ ID NO: 2032 - protein, 295 aa, Homo sapiens
MPSTWEAEAGGSAGRRAPPSSFRPGDAPVVPLCRQPDVLRRYFNRGGGGMFYLNTQLVNFNKQGENYRITPKPQNVVQQLGTGGVAGRQQGPEQARGVPWQSCLHPQATWPHTCPVYLSCARQYPQDSYSLKEHLPRAVPLVVMEGALVHLSIPVHQKPVSWRRDRETDLALCLLLHLRRDLPSAPWRAGRSKVASLGGMGLRAPQEHDRPSRPGYTEASARLGEALNGKGRCALGQVGELTGQQKWPWGPVLKGAVEGPCGLPSEAAQALRAAGVRMGAVWACRLFSQETSSSQ

SEQ ID NO: 2033 - protein, 110 aa, Homo sapiens
MAGPSCPYCLSTTLFDFSLSVGGQRKSPVALGTWDPELKTLQLALPCQCHRVPWPRKTGFLPSRPGHPVAILRVLPPPPGVTSENQEFVPVDFFCAMDHCPLTHSINLET

SEQ ID NO: 2034 - protein, 633 aa, Homo sapiens
MMNCWFSCTPKNRHAADWNKYDDRLMKAAERGDVEKVTSILAKKGVNPGKLDVEGRSVFHVVTSKGNLECLNAILIHGVDITTSDTAGRNALHLAAKYGHALCLQKLLQYNCPTEHADLQGRTALHDAAMADCPSSIQLLCDHGASVNAKDVDGRTPLVLATQMSRPTICQLLIDRGADVNSRDKQNRTALMLGCEYGCRDAVEVLIKNGADISLLDALGHDSSYYARIGDNLDILTLLKTASENTNKGRELWKKGPSLQQRNLTHMQDEVNVKSHQREHQNIQDLEIENEDLKERLRKIQQEQRILLDKVNGLQLQLNEEVMVADDLESEREKLKSLLAAKEKQHEESLRTIEALKNRFKYFESDHLGSGSHFSNRKEDMLLKQGQMYMADSQCTSPGIPAHMQSRSMLRPLELSLPSQTSYSENEILKKELEAMRTFCESAKQDRLKLQNELAHKVAECKALALECERVKEDSDEQIKQLEDALKDVQKRMYESEGKVKQMQTHFLALKEHLTSEAASGNHRLTEELKDQLKDLKVKYEGASAEVGKLRNQIKQNEMIVEEFKRDEGKLIEENKRLQKELSMCEMEREKKGRKVTEMEGQAKELSAKLALSIPAEKFENMKSSLSNEVNEK

SEQ ID NO: 2035 - protein, 975 aa, Homo sapiens
MLVKSEKEKRTTEHKVKNLTEEVEFLNEDISKLNRAAKVVQEAHQQTLDDLHMEEEKLSSLSKANLKLEQQVDELEGALEQERKARMNCERELHKLEGNLKLNRESMENLESSQRHLAEELRKKELELSQMNSKVENEKGLVAQLQKTVKELQTQIKDLKEKLEAERTTRAKMERERADLTQDLADLNERLEEVGGSSLAQLEITKKQETKFQKLHRDMEEATLHFETTSASLKKRHADSLAELEGQVENLQQVKQKLEKDKSDLQLEVDDLLTRVEQMTRAKANAEKLCTLYEERLHEATAKLDKVTQLANDLAAQKTKLWSESGEFLRRLEEKEALINQLSREKSNFTRQIEDLRGQLEKETKSQSALAHALQKAQRDCDLLREQYEEEQEVKAELHRTLSKVNAEMVQWRMKYENNVIQRTEDLEDAKKELAIRLQEAAEAMGVANARNASLERARHQLQLELGDALSDLGKVRSAAARLDQKQLQSGKALADWKQKHEESQALLDASQKEVQALSTELLKLKNTYEESIVGQETLRRENKNLQEEISNLTNQVREGTKNLTGMEKVKKLIEEEKTEVQVTLEETEGALERNESKILHFQLELLEAKAELERKLSEKDEEIENFRRKQQCTIDSLQSSLDSEAKSRIEVTRLKKKMEEDLNEMELQLSCANRQVSEATKSLGQLQIQIKDLQMQLDDSTQLNSDLKEQVAVAERRNSLLQSELEDLRSLQEQTERGRRLSEEELLEATERINLFYTQNTSLLSQKKKLEADVARMQKEAEEVVQECQNAEEKAKKAAIEAANLSEELKKKQDTIAHLERTRENMEQTITDLQKRLAEAEQMALMGSRKQIQKLESRARELEGELEGEIRRSAEAQRGARRLERCIKELTYQAEEDKKNLSRMQTQMDKLQLKVQNYKQQVEVAETQANQYLSKYKKQQHELNEVKERAEVAESQVNKLKIKAREFGKKVQEE

SEQ ID NO: 2036 - protein, 111 aa, Homo sapiens
MYMQATFLNQIIIYLEVRHVSIIRICKMASLSTYILIQKTHSECANWSFLIFFASTEENRIGKGKTDHSRIKSSCQKISSEGLYHYKMYPWSLHFHILLKFKIHMNKGLGI

SEQ ID NO: 2037 - protein, 115 aa, Homo sapiens
MNVCCSSHPVNEKVWKPSSRKWSSKVWSMDEFDLQTACYWFMTRCQKEAGKFGTHRGKPMCFVRSLLRVQLLPRTFPANSFVISFFPSLIYPLQVYQLHFESSDKQRAMQFVTEG

SEQ ID NO: 2038 - protein, 561 aa, Homo sapiens
MAERFHFVSSTSELHLMKMEFLELKYRLLSLLVLAESKLKSWIIKYGRRESVEQLLQNYVSFIENSKFFEQYEVTYQILKQTAEMYVKADGSVEEAENVMKFMNETTAQWRNLSVEVRSVRSMLEEVISNWDRYGNTVASLQAWLEDAEKMLNQSENAKKDFFRNLPHWIQQHTAMNDAGNFLIETCDEMVSRDLKQQLLLLNGRWRELFMEVKQYAQADEMDRMKKEYTDCVVTLSAFATEAHKKLSEPLEVSFMNVKLLIQDLEDIEQRVPVMDAQYKIITKTAHLITKESPQEEGKEMFATMSKLKEQLTKVKECYSPLLYESQQLLIPLEELEKQMTSFYDSLGKINEIITVLEREAQSSALFKQKHQELLACQENCKKTLTLIEKGSQSVQKFVTLSNVLKHFDQTRLQRQIADIHVAFQSMVKKTGDWKKHVETNSRLMKKFEESRAELEKVLRIAQEGLEEKGDPEELLRRHTEFFSQLDQRVLNAFLKACDELTDILPEQEQQGLQEAVRKLHKQWKVSQDRTETPCILNEGRSLSVLRSKCKRNLEIPGKSL

SEQ ID NO: 2039 - protein, 364 aa, Homo sapiens [sequence omitted]

SEQ ID NO: 2040 - protein, 135 aa, Homo sapiens
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQVGDGHPAGTTHPPGLSSREELCCGHS

SEQ ID NO: 2041 - protein, 532 aa, Homo sapiens
MLENLALISSLGCWCGSKDEEAPCKQRISVQRESQSRTPRAGVSPKKAHPCEMRGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGQTAYPCEECGKSFSQKGSLISHQLVHTGEGPYECRECGKSFGQKGNLIQHQQGHTGERAYHCGECGKSFRQKFCFINHQRVHTGERPYKCGECGKSFGQKGNLVHHQRGHTGERPYECKECGKSFRYRSHLTEHQRLHTEERPYNCRECGKLFNRKYHLLVHERVHTGERPYACEVCGKLFGNKHSVTIHQRIHTGERPYECSECGKSFLSSSALHVHKRVHSGQKPYKCSECGKSFSECSSLIKHRRIHTGERPYECTKCGKTFQRSSTLLHHQSSHRRKAL

SEQ ID NO: 2042 - protein, 171 aa, Homo sapiens
MWPRWKGEGVPLSVFFLCSSSFHLISISGLVCELKEFTHTWGGPLSPRQSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 2043 - protein, 118 aa, Homo sapiens
MGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVNPAEMFLSPCFMSVEET

SEQ ID NO: 2044 - protein, 135 aa, Homo sapiens
MQGYGQAAPTQLLPLSPGPCRPSDSSAPDSQEKLEMQNVTYLPVLDLFWSNQTYWQVKWLWSAHLNAAVFHPRSASKDTSLSLSLSPMPSLNGLTRCMWQVSGLPAPECWGWTRSPQPCSGERPEAREAEWRRQV

SEQ ID NO: 2045 - protein, 102 aa, Homo sapiens
MLAFGKGFKKLYGNINAKMLSRVQWCKAIVPSSWDYMHTPPCLANFCIFFFCIDGVLLSIYGDSLVAQAGFELLASSDSPASPSQSAGITGMSHCTSLLKRL

SEQ ID NO: 2046 - protein, 115 aa, Homo sapiens
MHNNCTPCGCMNLQGLLCALIHKLKAENVGRPSPAPPRSELPWFTREWSSDRTRHLPSGSSSAGPASGPGAAILRGLPAVKPSVRGDVHWIPDQLWVGLNPPSGFSGFVMIAPFV

SEQ ID NO: 2047 - protein, 593 aa, Homo sapiens
MCDIYIQSICKKLQVSRHKKFGYGVLVTRVASTAAGGIALKKSGFINELITELWSNLEYGRDDVRVTHPRTTPVDPIDRSCQKSFLALVNLLSYPAIYELVRNQDLPNKTEYSLREVPTCVIDIIDRLIILNSEAKIRSLFNYEQSHIFGLRLLSVICCDLDTLLLLEAQYQVSEMLLNAQEENILEISESHRDFIIDGLSVERNHVLVRINLVGGPLERILPPRLLEKSDNPYPWPMFSSYPLPNCYLSDITRNAGIKQDNDLDKLLLCLKISDKQTEWIENCQRQFCKMMKAKPDIISGEALIELLEKFVLHLTESPSECYFPSVEYTATDANVKNESLSSVQQLGIKMTVRYGKFLSLLKDGAENDLTWVLKHCERFLKQQQTSIKSSLLCLQGNYAGHDWFVSSLFMIMLGDKEKTFQFLHQFSRLLTSAFLWLPRLHISSYLPNDTVESGIHPVYFCSTHYIEMLLKAELPLVFSAFHMSGFAPSQICLQWITQCFWNYLDWIEICHYIATCVFLGPDYQVYICIAVFKHLQQDILQHTQTQDLQVFLKEEALHGFRVSDYFEYMEILEQNYRTVLLRDMRNIRLQST

SEQ ID NO: 2048 - protein, 155 aa, Homo sapiens
MDTDAEEAGVSTDAGGHYDCPQRAGRHEYALPLAPPEPEYATPIVERHVLRAHTFSAQSGYRVPGPQPGHKHSLSSGGFSPVAGVGAQDGDYQRPHSAQPADRGYDRPKAVSALATESGHPDSQKPPTHPGTSDSYSAPRDCLTPLNQTAMTALL

SEQ ID NO: 2049 - protein, 163 aa, Homo sapiens
MTNCPRQQTERQTNCPRQQTDKQTAPDSRQTNRHIALDSRETNRHTAPDSRQTDTLPQTADRKTAPDSRQTDKLPQTADRQTAPESRQQTAPDSRQTDTLPQTADRQTPCPRQQTSCPGQPAHLACHSACPTGRSLPSHPGSPAIFTSPGPCSGSLVTLANCT

SEQ ID NO: 2050 - protein, 1052 aa, Homo sapiens
MQDYNKDDMSYRRISAVEPKTALPFNRFLPNKSRQPSYVPAPLRKKKPDKHEDNRRSWASPVYTEADGTFSSQFLLLQALQTYSDDILSSETHTKIDPTSGPGLITRRKNLSYAPGYRRDDLEMAALDPDLENDDFFVRKTGAFHANPYVLRAFEDFRKFSEQDDSVERDIILQCREGELVLPDLEKDDMIVRRIPAQKKEVPLSGAPDRYHPVPFPEPWTLPPEIQAKFLCVLERTCPSKEKSNSCRILVPSYRQKKDDMLTRKIQSWKLGTTVPPISFTPGPCSEADLKRWEAIREASRLRHKKRLMVERLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFNDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYS

SEQ ID NO: 2051 - protein, 285 aa, Homo sapiens
MLEIKMEEAMTYTEDSYGMDGKVNQPRLTADINWQGLEELHSVNENIYEYRQNYRLSLVDWTNYLKDLDRVFALLKSHYEQNKTNKTQTAQSDGFLVVSAEHAVSMEMASADSDEDPRHKVGKTPHLTLPADLQTLHLNRPTLSPESKLEWNNDIPEVNHLNSEHWRKTEKWTGHEETNHLETDFSGNGMTELELGPSPRLQPIRRHPKELPQYGGPGKDIFEDQLYLPVHSDGISVHQMFTMATAEHRSNSSIAGKMLTKVEKNHEKEKSQHLEGSASSSLSSD

SEQ ID NO: 2052 - protein, 211 aa, Homo sapiens [sequence omitted]

SEQ ID NO: 2053 - protein, 127 aa, Homo sapiens
MYLGFIYPKRFFHLRRVRTANPELSAQCPGLLCSESGSAPPPGWRGWPWSWSKVGFLEEGRHIRTSDGAAHNLTRPLQPILTSSLLASGKGACTIRAEGWASCRHKNWLQWKPEAEDIGTKFCCAPW

SEQ ID NO: 2054 - protein, 248 aa, Homo sapiens
MGLSRVRAVFFDLDNTLIDTAGASRRGMLEVIKLLQSKYHYKEEAEIICDKVQVKLSKECFHPYNTCITDLRTSHWEEAIQETKGGAANRKLAEECYFLWKSTRLQHMTLAEDVKAMLTELRKEVRLLLLTNGDRQTQREKIEACACQSYFDAVVVGGEQREEKPAPSIFYYCCNLLGVQPGDCVMVGDTLETDIQGGLNAGLKATVWINKNGIVPLKSSPVPHYMVSSVLELPALLQSIDCKVSMST

SEQ ID NO: 2055 - protein, 100 aa, Homo sapiens [sequence omitted]

SEQ ID NO: 2056 - protein, 111 aa, Homo sapiens
MPACKGRERVLLSCRRRCRQGEGLGVGGGQLSAQDPSGPTPGPWAPTALSPALSSGMGPGLRRRSKLCSPSTTTSGGSAQLLWAQVPRPFPDVTPQSGPHSRGGPPLMCVF

SEQ ID NO: 2057 - protein, 578 aa, Homo sapiens
MLENYRNLVSLDLDLQCEIISYIEVPTYETDISSTQLQSIYEREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKLYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGMKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 2058 - protein, 137 aa, Homo sapiens
MVFKSKDKQHCQKAVLAPHPPPKSFFQTPPGIFLTPLAEQTSRGCPCGLRAPRERNWANFVLWDGGPFTASLEAKLICRVTIMLSHEQTEGEKRPSSLPSPPTYPVPSQGKWYQTEPSKSLTKFRWEFFLHVGERRA

SEQ ID NO: 2059 - protein, 187 aa, Homo sapiens [sequence omitted]

SEQ ID NO: 2060 - protein, 517 aa, Homo sapiens
MSLGSELFRDVAIVFSQEEWQWLAPAQRDLYRDVMLETYSNLVSLGLAVSKPDVISFLEQGKEPWMVERVVSGGLCPVLESRYDTKELFPKQHVYEVESPQWEIMESLTSYGLECSSFQDDWECRNQFDRQQGNPDRHFHQMIIRHEEMPTFDQHASLTFYQKIHTREKPFGYNKCRKDFWQKELLINHQGIYTNEKPYKCKECGKAFKYGSRLIQHENIHSGKKPYECKECGKAFNSGSNFIQHQRVHTGEKPYECKDCEKAFSRSSQLIEHQRTHTGEKPYQCKECGKAFNRISHLKVHYRIHTGEKPYACKECGKTFSHRSQLIQHQTVHTGRKLYECKECGKAFNQGSTLIRHQRIHTGEKPYECKVCGKAFRVSSQLKQHQRIHTGEKPYQCKVCGRAFKRVSHLTVHYRIHTGEKPYECKECGKAFSHCSQLIHHQVIHTEKKPYEYKECEKTLSHDSTTVQPQRMHNRETHVNIINVEKPSISSYPLLIIREFMLASNHMNGSNGESPLA

SEQ ID NO: 2061 - protein, 213 aa, Homo sapiens
MPGFEGAGDGLVQTWGLLAAGAGSEEVSSQPRQGINLGHSSHSQDLPVTMAVGKFLLGSLLLLSLQLGQGWGPDARGVPVADGEFSSEQVAKAGGTWLGKDFQGPSVTSQLSPALTLLTVSALPSHRHPPPPCPPAPSPVWSMPAVEPDPVRGRARPGLRLRGEGHLPLLRRQLPPWCPHPAWPGAGPAAGPGPSPRRALLPAHSLHRRGLPR

SEQ ID NO: 2062 - protein, 626 aa, Homo sapiens [sequence omitted]

SEQ ID NO: 2063 - protein, 402 aa, Homo sapiens
MAAVILPSTAAPSSLFPASQQKGHTQGGELVNELLTSWLRGLVTFEDVAVEFTQEEWALLDPAQRTLYRDVMLENCRNLASLGCRVNKPSLISQLEQDKKVVTEERGILPSTCPDLETLLKAKWLTPKKNVFRKEQSKGVKTERSHRGVKLNECNQCFKVFSTKSNLTQHKRIHTGEKPYDCSQCGKSFSSRSYLTIHKRIHNGEKPYECNHCGKAFSDPSSLRLHLRIHTGEKPYECNQCFHVFRTSCNLKSHKRIHTGENHHECNQCGKAFSTRSSLTGHNSIHTGEKPYECHDCGKTFRKSSYLTQHVRTHTGEKPYECNECGKSFSSSFSLTVHKRIHTGEKPYECSDCGKAFNNLSAVKKHLRTHTGEKPYECNHCGKSFTSNSYLSVHKRIHNRWI

SEQ ID NO: 2064 - protein, 277 aa, Homo sapiens
METYAEVGKEGKPPCASVDLQGDSSLQVEISDAVSERDKVKFTVQTKSCLPHFAQTEFSVVRQHEEFIWLHDAYVENEEYAGLIIPPAPPRPDFEASREKLQKLGEGDSSVTREEFAKMKQELEAEYLAIFKKTVAMHEVFLQRLAAHPTLRRDHNFFVFLEYGQDLSVRGKNRKELLGGFLRNIVKSADEALITGMSGLKEVDDFFEHERTFLLEYHTRIRDACLRADRVMRAHKCTQGPRGPGSPCPSPQRFNSLGERREQGVPCCLSVATSTKA

SEQ ID NO: 2065 - protein, 672 aa, Homo sapiens [sequence omitted]

SEQ ID NO: 2066 - protein, 161 aa, Homo sapiens
MSHHALPDMRKYYPLWQSALSLLKYLTPNARNKSYSCLFFETEFALVAQTGVQLRDLSSPQPLPPGFKPFSHLSLPSSWDYRHAPACLANFVFLVETGFLHVGQAGLELPTSGDPPALASQSAEITGVSHRARPLFLLLCADIERLSTWASSCCAQFLARP

SEQ ID NO: 2067 - protein, 104 aa, Homo sapiens [sequence omitted]

SEQ ID NO: 2068 - protein, 109 aa, Homo sapiens
MPKSRALPPSIGTGHAETSESFAIPLLLSDDSGFLLTFLMGMTGPVSWVANFCSSAELSPFLGAEGFLGKRMSLEQYSFRRCTLACRESVDLFCLLGSTEMPVVRVTFL

SEQ ID NO: 2069 - protein, 141 aa, Homo sapiens
MTVLTTPITLVGNRTDLADKRQVSVEEGERKAKGLNVTFIETRAKTGYNVKQLFRRVAAALPGMESTQDGSREDMSDIKLEKPQEQTVSEGGCSCYSPMSSSTLPQKPPYSFIDCSVNIGLNLFPSLITFCNSSLLPVSWR

SEQ ID NO: 2070 - protein, 112 aa, Homo sapiens
MKALYAQSPAGTCWALQSVWAGGSSELGTTLPIKLQQCWAWWLTPVIPALWEAEAGGSPEVRSSRPALPKWRNPVFTKNTKINQAWWHTPVVPATREAEAGESLESGRWRLQ

SEQ ID NO: 2071 - protein, 792 aa, Homo sapiens [sequence omitted]

SEQ ID NO: 2072 - protein, 256 aa, Homo sapiens [sequence omitted]

SEQ ID NO: 2073 - protein, 184 aa, Homo sapiens [sequence omitted]

SEQ ID NO: 2074 - protein, 131 aa, Homo sapiens [sequence omitted]

SEQ ID NO: 2075 - protein, 105 aa, Homo sapiens
MTTQRATWHCQKSPGKERKCENEKTNIGLYWTGHMYYIRFSLATCIESLSFPTTLKTLIKRHTTGHEIWHPKLPPANLEVWVPTLWVYLSHLASALSLRLSFQKT

SEQ ID NO: 2076 - protein, 242 aa, Homo sapiens [sequence omitted]

SEQ ID NO: 2077 - protein, 605 aa, Homo sapiens
MLLFVEVASKGTGLNPNAKVWQEIAPGNTDATPVTHGTESSWHEIAATSGAHPEGNAELSEDICKEYEVMYSSSCETTRNTTGIEESTDGMILGPSHKRCIVILREIPETTPIEEVKGLFKSENCPKVISCEFAHNSNWYITFQSDTDAQQAFKYLREEVKTFQGKPIMARIKAINTFFAKNGYRLMDSSIYSHPIQTQAQYASPVFMQPVYNPHQQYSVYSIVPQSWSPNPTPYFETPLAPFPNGSFVNGFNSPGSYKTNAAAMNMGRPFQKNRVKPQFRSSGGSEHSTEGSVSLGDGQLNRYSSRNFPAERHNPTVTGHQEQTYLQKETSTLQVEQNGDYGRGRRTLFRGRRRREDDRISRPHPSTAESKAPTPKFDLLASNFPPLPGSSSRMPGELVLENRMSDVVKGVYKEKDNEELTISCPVPADEQTECTSAQQLNMSTSSPCAAELTALSTTQQEKDLIEDSSVQKDGLNQTTIPVSPPSTTKPSREPRKLSYAEVCQKPPKEPSSVLVQPLRELRSNVVSPTKNEDNGAPENSVEKPHEKPEARASKDYSGFRGNIIPRGAAGKIREQRRQFSHRAIPQGVTRRNGKEQYVPPRSPK

SEQ ID NO: 2078 - protein, 121 aa, Homo sapiens
MGHPLMQGLADSAPEPLLLLQGKFTWRPNREDRANWTYLASLGDWSLPGLLITSSSPSYPSVTSKAPFPNPGAGSEKKCWKTTLLRSLSALMGHSSPLAPPSTTFQSSILGTLQPNLLRPW

SEQ ID NO: 2079 - protein, 135 aa, Homo sapiens
MELCGNDSVYAYASSVFRKAGVPEAKIQYAIIGTGSCELLTAVVSVSLEGALPPPALWGGTPRSSALNQFTLQLMVLKCSEGPGAVAHACKPSTLGGRGGWITRSGVRDQPGQHSETPVSTKKYKKLSRRGGGRL

SEQ ID NO: 2080 - protein, 258 aa, Homo sapiens
MNMLEVFVSSLEEFQPDLVVLSGLHMMEGQSKELQRKRLLEVVTSISDIPTGIPVHLELASMTNRELMSSIVHQQVFPAVTSLGLNEQELLFLTQSASGPHSSLSSWNGVPDVGMVSDILFWILKEHGRSKSRASDLTRIHFHTLVYHILATVDGHWANQLAAVAAGARVAGTQACATETIDTSRVSLRAPQEFMTSHSEAGSRIVLNPNKPVVEWHREGISFHFTPVLVCKDPIRTVGLGDAISAEGLFYSEVHPHY

SEQ ID NO: 2081 - protein, 109 aa, Homo sapiens [sequence omitted]

SEQ ID NO: 2082 - protein, 174 aa, Homo sapiens
MQRVARAAARRSRRTQPLRRPGGRRGHSAAIQGYPGARQKQGRAPDVPWQLRPDPRNAPGGSPHPEMCPQGSLDRPGGEAGPPEVARGCPAPSWRLPGARRASQSRWGSHRGSVSRAGPGSLLSRPAPQVLAHPPRPRRPSTHGCGRRVALPVALGAPPPEGPRAHWQAAPCTR

SEQ ID NO: 2083 - protein, 458 aa, Homo sapiens
MELEKREKRSLLNKNLEEKLTVSAGGSEAKPLIFTFVPTVRRLPTHTQLADTSKFLVKIPEESSDKSPETVNRSKSNDYLTLNAGSQQERDQAKLTCPSEVSGTILQEREFEANKLQGMQQSDLFKAEYVLIVDSEGEDEAASRKVEQGPPGGIGTAAIRPKSLAISSSLVSDVVRPKTQGTDLKTSSHPEMLHGMAPQQKHGQQYKTKSSYKAFAAIPTNTLLLEQKALDEPAKTESVSKDNTLEPPVELYFPAQLRQQTEELCATIDKVLQDSLSMHSSDSPSRSPKTLLGSDTVKTPTTLPRAAGRETKYANLSSPTSTVSESQLTKPGVIRPVPVKSRILLKKEEEVYEPNPFSKYLEDNSDLFSEQDVTVPPKPVSLHPLYQTKLYPPAKSLLHPQTLSHADCLAPGPFSHLSFSLSDEQENSHTLLSHNACNKLSHPMVAIPEHEALDSKEQ

SEQ ID NO: 2084 - protein, 102 aa, Homo sapiens
MMHFGGYIQKQAQTERKSGKRQTEREKKKKILAERRKVLAIDHLNEDQLREKAKELWQSIYNLEAEKFDLQEKFKQQKYEVGRHAVPAQHLHLTLLLVHWVR

SEQ ID NO: 2085 - protein, 230 aa, Homo sapiens
MEKPRLYQKYKISRVWWRLPVIPATREAEDNRLNPEGRGCGEPRSRHCTPAWTTTAKLHLKTIISLQPLNMYQMEPGVGSIRTSPALQSPPALTRGPSAWDTAIRKALSFGVGLGVLVLVCLFYHFVTLAPILQFASLPCLLEAGAQMSRHPVTTQVCIMPARLSLGSGISRNLLRLSVCHFTLLLPFRSLRPCPLSSRDMVLSYELWLLCDFYIAPPDSSGSGICKKAI

SEQ ID NO: 2086 - protein, 466 aa, Homo sapiens
MLRSTSTVTLLSGGAARTPGAPSRRANVCRLRLTVPPESPVPEQCEKKIERKEQLLDLSNGEPTRKLPQGVVYGVVRRSDQNQQKEMVVYGWSTSQLKEEMNYIKDVRATLEKVRKRMYGDYDEMRQKIRQLTQELSVSHAQQEYLENHIQTQSSALDRFNAMNSALASDSIGLQKTLVDVTLENSNIKDQIRNLQQTYEASMDKLREKQRQLEVAQVENQLLKMKVESSQEANAEVMREMTKKLYSQYEEKLQEEQRKHSAEKEALLEETNSFLKVIEEANKKMQAAEISLEEKDQRIGELDRLIERMEKERHQLQLQLLEHETEMSGELTDSDKERYQQLEEASASLRERIRHLDDMVHCQQKKVKQMVEEIESLKKKLQQKQLLILQLLEKISFLEGENNELQSRLDYLTETQAKTEVETREIGVGCDLLPSQTGRTREIVMPSRNYTPYTRVLELTMKKTLT

SEQ ID NO: 2087 - protein, 145 aa, Homo sapiens
MDYGGHTPLHCALQGPAAALAQSPEHVVRALLNHGAVRVWPGALPKVLERWSTCPRTIEVLMNTYSVVQLPEEAVGLVTPETLQKHQRFYSSLFALVRQPRSLQHLSRCALRSHLEGSLPQALPRLPLPPRLLRYLQLDFEGVLY

SEQ ID NO: 2088 - protein, 118 aa, Homo sapiens [sequence omitted]

SEQ ID NO: 2089 - protein, 421 aa, Homo sapiens [sequence omitted]

SEQ ID NO: 2090 - protein, 374 aa, Homo sapiens
MRPGTALQAVLLAVLLVGLRAATGRLLSGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 2091 - protein, 199 aa, Homo sapiens
MYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 2092 - protein, 642 aa, Homo sapiens
MCNRTSSPIPAQHAPRPYASSLEKGPPKPGPPRRLSAPLPSSCGDPEKQRQDKMREEGLQLVSMIREGEAAGACPEEIFSALQYSGTEVPLQWLRSELPYVLEMVAELAGQQDPGLGAFSCQEARRAWLDRHGNLDEAVEECVRTRRRKVQELQSLGFGPEEGSLQALFQHGGDVSRALTELQRQRLEPFRQRLWDSGPEPTPSWDGPDKQSLVRRLLAVYALPSWGRAELALSLLQETPRNYELGDVVEAVRHSQDRAFLRRLLAQECAVCGWALPHNRMQALTSCECTICPDCFRQHFTIALKEKHITDMVCPACGRPDLTDDTQLLSYFSTLDIQLRESLEPDAYALFHKKLTEGVLMRDPKFLWCAQCSFGFIYEREQLEATCPQCHQTFCVRCKRQWEEQHRGRSCEDFQNWKRMNDPEYQAQGLAMYLQENGIDCPKCKFSYALARGGCMHFHCTQCRHQFCSGCYNAFYAKNKCPEPNCRVKKSLHGHHPRDCLFYLRDWTALRLQKLLQDNNVMFNTEPPAGARAVPGGGCRVIEQKEVPNGLRDEACGKETPAGYAGLCQAHYKEYLVSLINAHSLDPATLYEVEELETATERYLHVRPQPLAGEDPPAYQARLLQKLTEEVPLGQSIPRRRK

SEQ ID NO: 2093 - protein, 401 aa, Homo sapiens [sequence omitted]

SEQ ID NO: 2094 - protein, 622 aa, Homo sapiens
MNKLNFHNNRVMQDRRSVCIFLPNDESLNIIINVKILCHQLLVQVCDLLRLKDCHLFGLSVIQNNEHVYMELSQKLYKYCPKEWKKEASKVRQYEVTWGIDQFGPPMIIHFRVQYYVENGRLISDRAARYYYYWHLRKQVLHSQCVLREEAYFLLAAFALQADLGNFKRNKHYGKYFEPEAYFPSWVVSKRGKDYILKHIPNMHKDQFALTASEAHLKYIKEAVRLDDVAVHYYRLYKDKREIEASLTLGLTMRGIQIFQNLDEEKQLLYDFPWTNVGKLVFVGKKFEILPDGLPSARKLIYYTGCPMRSRHLLQLLSNSHRLYMNLQPVLRHIRKLEENEEKKQYRESYISDNLDLDMDQLEKRSRASGSSAGSMKHKRLSRHSTASHSSSHTSGIEADTKPRDTGPEDSYSSSAIHRKLKTCSSMTSHGSSHTSGVESGGKDRLEEDLQDDEIEMLVDDPRDLEQMNEESLEVSPDMCIYITEDMLMSRKLNGHSGLIVKEIGSSTSSSSETVVKLRGQSTDSLPQTICRKPKTSTDRHSLSLDDIRLYQKDFLRIAGLCQDTAQSYTFGCGHELDEEGLYCNSCLAQQCINIQDAFPVKRTSKYFSLDLTHDEVPEFVV

SEQ ID NO: 2095 - protein, 750 aa, Homo sapiens
MGDTAKPYFVKRTKDRGTMDDDDFRRGHPQQDYLIIDDHAKGHGSKMEKGLQKKKITPGNYGNTPRKGPCAVSSNPYAFKNPIYSQPAWMNDSHKDQSKRWLSDEHTGNSDNWREFKPGPRIPVINRQRKDSFQENEDGYRWQDTRGCRTVRRLFHRDLTSLETTSEMEAGSPENKKQRSRPRKPRKTRNEENEQDGDLEGPVIDESVLSTKELLGLQQAEERLKRDCIDRLKRRPRNYPTAKYTCRLCDVLIESIAFAHKHIKEKRHKKNIKEKQEEELLTTLPPPTPSQINAVGIAIDKVVQEFGLHNENLEQRLEIKRIMENVFQHKLPDCSLRLYGSSCSRLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKN

SEQ ID NO: 2096 - protein, 282 aa, Homo sapiens [sequence omitted]

SEQ ID NO: 2097 - protein, 107 aa, Homo sapiens [sequence omitted]

SEQ ID NO: 2098 - protein, 116 aa, Homo sapiens [sequence omitted]

SEQ ID NO: 2099 - protein, 638 aa, Homo sapiens
MAGLSGAQIPDGEFTAVVYRLIRNARYAEAVQLLGGELQRSPRSRAGLSLLGYCYYRLQEFALAAECYEQLGQLHPELEQYRLYQAQALYKACFYAEATRVAFLLLDNPAYHSRVLHLQAAIKYSEGDLPGSRSLVEQLPSREGGEESGGENETDGQINLGCLLYNLALAYYSSRQYASALKHIAEIIERGIRQHPELGVGMTTEGIDVRSVGNTLVLHQTALVEAFNLKAAIEYQLRNYEAAQEALTDMPPRAEEELDPVTLHNQALMNMDARPTEGFEKLQFLLQQNPFPPETFGNLLLLYCKYEYFDLAADVLAENAHLIYKFLTPYLYDFLDAVTTCQTAPEEAFIKLDGLAGMLTEVLRKLTIQVQEARHNRDDEAIKKAVNEYDETMEKYIPVLMAQAKIYWNLENYPMVEKIFRKSVEFCNDHDVWKLNVAHVLFMQENKYKEAIGFYEPIVKKHYDNILNVSAIVLANLCVSYIMTSQNEEAEELMRKIEKEEEQLSYDDPDKKMYHLCIVNLVIGTLYCAKGNYDFGISRVIKSLEPYNKKLGTDTWYYAKRCFLSLLENMSKHTIMLRDSVIQECVQFLEHCELHGRNIPAVIEQPLEEERMHVGKNTVTYESRQLKALIYEIIGWNI

SEQ ID NO: 2100 - protein, 456 aa, Homo sapiens
MDSRLQEIRERQKLRRQLLAQQLGAESADSIGAVLNSKDEQREIAETRETCRASYDTSAPNAKRKYLDEGETDEDKMEEYKDELEMQQDEENLPYEEEIYKDSSTFLKGTQSLNPHNDYCQHFVDTGHRPQNFIRDVGLADRFEEYPKLRELIRLKDELIAKSNTPPMYLQADIEAFDIRELTPKFDVILLEPPLEEYYRETGITANEKCWTWDDIMKLEIDEIAAPRSFIFLWCGSGEGLDLGRVCLRKWGYRRCEDICWIKTNKNNPGKTKTLDPKAVFQRTKEHCLMGIKGTVKRSTDGDFIHANVDIDLIITEEPEIGNIEKPVEIFHIIEHFCLGRRRLHLFGRDSTIRPGWLTVGPTLTNSNYNAETYASYFSAPNSYLTGCTEEIERLRPKSPPPKSKSDRGGGAPRGGGRGGTSAGRGRERNRSNFRGERGGFRGGRGGAHRGGFPPR

SEQ ID NO: 2101 - protein, 388 aa, Homo sapiens [sequence omitted]

SEQ ID NO: 2102 - protein, 767 aa, Homo sapiens [sequence omitted]

SEQ ID NO: 2103 - protein, 177 aa, Homo sapiens [sequence omitted]

SEQ ID NO: 2104 - protein, 133 aa, Homo sapiens
MKSDAAGPSAGLMGRPGGALPVFPSHRQASRLDPPAPPDAGCRGLVLYSRRRLMSEASQMPAPPSAPPRASPSHIPARGTPSARPHLRPEHAPRLAPPRPRPQLRPDRKKPRHPALIGPGMGVPPLPSQFCVR

SEQ ID NO: 2105 - protein, 446 aa, Homo sapiens
MVTFEDVAVHFTKTEWTGLSPAQRALYRSVMLENFGNLTALGYPVPKPALISLLERGDMAWGLEAQDDPPAERTKNVCKDVETNIDSESTLIQGISEERDGMMSHGQLKSVPQRTDFPETRNVEKHQDIPTVKNIQGKVPRIPCARKPFICEECGKSFSYFSYYARHQRIHTGEKPFECSECGKAFNGNSSLIRHQRIHTGERPYQCEECGQAFNDNANLIRHQRIHSGDRPYYCTECGNSFTSSSEFVIHQRIHTGEKPYECNECGKAFVGNSPLLRHQKIHTGEKPYECNECGKSFGRTSHLSQHQRIHTGEKPYSCKVCGQAFNFHTKLTRHQRIHSEEKPFDCVDCGKAFSAQEQLKRHLRIHTQESSYVCDECGKALTSKRNLHQHQRIHTGEKPYECSKYEKAFGTSSQLGHLEHVYSGEKPVLDICRFGLPEFFTPFYW

SEQ ID NO: 2106 - protein, 347 aa, Homo sapiens
MQDSPIVVCTLLCTHKYVYHSGEDVHSFHEITMNNDLTVLRIINLVRYKTSFSTGRSEDNLSATPPALRIILVGKTGCGKSATGNSILGQPVFESKLRAQSVTRTCQVKTGTWNGRKVLVVDTPSIFESQADTQELYKNIGDCYLLSAPGPHVLLLVIQLGRFTAQDTVAIRKVKEVFGTGAMRHVVILFTHKEDLGGQALDDYVANTDNCSLKDLVRECERRYCAFNNWGSVEEQRQQQAELLAVIERLGREREGSFHSNDLFLDAQLLQRTGAGACQEDYRQYQAKVEWQVEKHKQELRENESNWAYKALLRVKHLMLLHYEIFVFLLLCSILFFIIFLFIFHYI

SEQ ID NO: 2107 - protein, 179 aa, Homo sapiens
MASLMGFSGGCYCRVSGTDYYCSALEMLNLSSYPIWVSLFRGSPRRAASCQYPLSLQHPSSSSPTWTQDPEPTEGMERTSRAPQVGGPIPWGQAHLRTSLELQGCESQPHTALTPAPLSQTLRLLSSFAIRCSILGKLGWERLHKTSLLPLTLAPPISGSRPGDATSSVCPAVSFYVGE

SEQ ID NO: 2108 - protein, 475 aa, Homo sapiens [sequence omitted]

SEQ ID NO: 2109 - protein, 172 aa, Homo sapiens
MPIIDQVNPELHDFMQRYICVCISVCMHTHAHTPPHLKHSSQAERSFLIVLGGFVKFSPVVPVTSNLGNSVLGAFLGTVLFGGHSPSLEFTSSGERWIRYVCQGKMLRLLPQEKHKVLWDPVARRGRPTMGCFISQVPKRRNIFLQIPCDVLFLLCLVGNVFLANASFFKIF

SEQ ID NO: 2110 - protein, 254 aa, Homo sapiens
MTLEDIVQREVWGTVVARGAPAPPGPVPTRGAASRRLSVSPASTSETSLYQVLLGARQLVQPGPHAMYARVRQVESNPLYQGTASSADVALVELEAPVPFTNYILPVCLPDPSVIFETGMNCWVTGWGSPSEEDLLPEPRILQKLAVPIIDTPKCNLLYSKDTEFGYQPKTIKNDMLCAGFEEGKKDACKGDSGGPLVCLVGQSWLQAGVISWGEGCARQNRPGVYIRVTAHHNWIHRIIPKLQFQPARLGGQK

SEQ ID NO: 2111 - protein, 107 aa, Homo sapiens
MGAGPGACLAGGWVWVEARWGSWCRVGQLWPRGSPPWRTPPGPRPPSLGNGSFLRARVVRLLVRAALVKTQCPVSLRQPLSSAQNTDDLIDSSRQPWEIWVPWDVHT

SEQ ID NO: 2112 - protein, 134 aa, Homo sapiens
MRHSRQEGAPPRPGLSLEPRSCRRGAFCGCPHTTPGKGWGRGTLHDMAAGRSHFFETSVNWTRPTSHTLGEPRERLWPGGLQGVGSGGGERPQPFPVPPTSLAFLAVSRGQWRGVREGPPDGLSCDSSYKAPRA

SEQ ID NO: 2113 - protein, 103 aa, Homo sapiens
MFLLLLVEGNIKWGWGQFMLRRANFAYGTGDIEWLLSRALEGLGDTSAALGISQGHGRPHSRLGPPLCELRSAGRLTSEAAPGPLEALPLRHGPRSESREGCC

SEQ ID NO: 2114 - protein, 309 aa, Homo sapiens [sequence omitted]

SEQ ID NO: 2115 - protein, 517 aa, Homo sapiens [sequence omitted]

SEQ ID NO: 2116 - protein, 569 aa, Homo sapiens
MSKDLVTFGDVAVNFSQEEWEWLNPAQRNLYRKVMLENYRSLVSLGVSVSKPDVISLLEQGKEPWMVKKEGTRGPCPDWEYVFKNSEFSSKQETYEESSKVVTVGARHLSYSLDYPSLREDCQSEDWYKNQLGSQEVHLSQLIITHKEILPEVQNKEYNKSWQTFHQDTIFDIQQSFPTKEKAHKHEPQKKSYRKKSVEMKHRKVYVEKKLLKCNDCEKVFNQSSSLTLHQRIHTGEKPYACVECGKTFSQSANLAQHKRIHTGEKPYECKECRKAFSQNAHLAQHQRVHTGEKPYQCKECKKAFSQIAHLTQHQRVHTGERPFECIECGKAFSNGSFLAQHQRIHTGEKPYVCNVCGKAFSHRGYLIVHQRIHTGERPYECKECRKAFSQYAHLAQHQRVHTGEKPYECKVCRKAFSQIAYLDQHQRVHTGEKPYECIECGKAFSNSSSLAQHQRSHTGEKPYMCKECRKTFSQNAGLAQHQRIHTGEKPYECNVCGKAFSYSGSLTLHQRIHTGERPYECKDCRKSFRQRAHLAHHERIHTMESFLTLSSPSPPTSNQLPRPVGFIS

SEQ ID NO: 2117 - protein, 195 aa, Homo sapiens
MEAARRPRLGLSRRRPPPAGGPSGGRPWFLLGGDERERLWAELLRTVSPELILDHEVPSLPAFPGQEPRCGPEPTEVFTVGPKTFSWTPFPPDLWGPGRSYRLLHGAGGHLESPARSLPQRPAPDPCRAPRVEQQPSVEGAAALRSCPMCQKEFAPRLTQLDVDSHLAQCLAESTEDVTCLSWMCKTLNDPGSQG

SEQ ID NO: 2118 - protein, 729 aa, Homo sapiens
MPSVGFIPMTSAVIDEFVGDMMKDLPILKSDDPVVPSLFKQKTSDELLHWHAQRLLSDDYDRIKCHVDEQSRDPHVLDFLKKIQDYQQFYGKSLESISTKVIVTQTTRPKEDSSGASGEILQNTKPHQITKKSKKKSFLKEDQNKAQQNDDLLFSIEEEMKNNLHSGIRKLEDYLTSCASNSVKFGVEMLGLIACFKAWKKHCRGEGKISKDLSIAVQMMKRIHSLLERYPEILEAEHHQYIAKCLKYLGFNDLANSLDPTLIGDDKNKKKYSIDIGPARFQLQYMGHYLIRDERKDRDPRVQDFIPNAWQQELLDVVDKNESAVIVAPTSSGKTYASYYCMEKVLRESDVGVVVYVAPAKSLVGQVAATVENRFTKTLPAGRTLCGAFTRDYRHNVLNCQVLITVPECFEILLLAPHRQKWVERIRYVIFDEVHYLGREVGAKFWELLLVIIRCPFLVLSATINNPNLLTKWLQSVKQYWKQADKIMEEKCISEKQADKCLNFLQDHSYKNQSYEVRLVLCGERYNDLEKHICSVKHDDVYFDHFHPCAALTTDIIEKYGFPPDLTLTPQESIQLYDTMAQVWETWPRAQELCPEEFILFKNKIVIKKLDARKYEENLKAELTNWIKNGQVKKVKRVLKNLSPDSLSSSKDMVKMFPLLVEKLRQMDKLPAIFFLFKNDDVGKRAGSVCTFLEKTETKSHPHTECHSYVFAIDEVLEKVRKTQKRIST

SEQ ID NO: 2119 - protein, 141 aa, Homo sapiens
MVCEDAPSFQMAWESQMAWERGPALLCCVLSASQLSSQDQDPLGHIKSLLYPFGFPVELPRPGPTGAYKKVKNQNQTTSSELLRKQTSHFNQRGHRARSKLLASRQIPDRTLNVGSGFPRSHPLFRDRVDIIFIGAMYASA

SEQ ID NO: 2120 - protein, 717 aa, Homo sapiens
MASSSDSEDDSFMAVDQEETVLEGTMDQDEEPHPVLEAEETRHNRSMSELPEEVLEYILSFLSPYQEHKTAALVCKQWYRLIKGVAHQCYHGFMKAVQEGNIQWESRTYPYPGTPITQRFSHSACYYDANQSMYVFGGCTQSSCNAAFNDLWRLDLNSKEWIRPLASGSYPSPKAGATLVVYKDLLVLFGGWTRPSPYPLHQPERFFDEIHTYSPSKNWWNCIVTTHGPPPMAGHSSCVIDDKMIVFGGSLGSRQMSNDVWVLDLEQWAWSKPNISGPSPHPRGGQSQIVIDDATILILGGCGGPNALFKDAWLLHMHSGPWAWQPLKVENEEHGAPELWCHPACRVGQCVVVFSQAPSGRAPLSPSLNSRPSPISATPPALVPETREYRSQSPVRSMDEAPCVNGRWGTLRPRAQRQTPSGSREGSLSPARGDGSPILNGGSLSPGTAAVGGSSLDSPVQAISPSTPSAAEGYDLKIGLSLAPRRGSLPDQKDLRLGSIDLNWDLKPASSSNPMDGMDNRTVGGSMRHPPEQTNGVHTPPHVASALAGAVSPGALRRSLEAIKAMSSKGPSASAALSPPLGSSPGSPGSQSLSSGETVPIPRPGPAQGDGHSLPPIARRLGHHPPQSLNVGKPLYQSMNCKPMQMYVLDIKDTKEKGRVKWKVFNSSSVVGPPETSLHTVVQGRGELIIFGGLMDKKQNVKYYPKTNALYFVRAKR

SEQ ID NO: 2121 - protein, 100 aa, Homo sapiens
MPAAPLPSSDSPRALRGRGRSTTSTSPQRGSAPSYGGAVGQAAQTPGWLPDGPGSPSPSSGLCLWEPLGQGPRVAESTFPLFIPLRVLHRLPWQLSSRVG

SEQ ID NO: 2122 - protein, 188 aa, Homo sapiens
MDSYSAPESTPSASSRPEDYFIGATPLQKRLESVRKQSSFILTPPRRKIPQCSQLQEDVDPQKVAFLLHKQWTLYSLTPLYKFSYSNLKEYSRLLNAFIVAEKQKGLAVEVGEDFNIKVIFSTLLGMKGTQRDPEAFLVQGLILSPRLEYSGTILVDCNLCLLGSSDPSTLAFQVAGTADCVKISIAI

SEQ ID NO: 2123 - protein, 148 aa, Homo sapiens [sequence omitted]

SEQ ID NO: 2124 - protein, 413 aa, Homo sapiens
MELKPLRVYSEQAEASEFPVPRVGSRKLLRKSPREGRPNQSLRSITLHHRIRQAPNPYSSEIKAFDTRLQRGELFSREDLVWYKKVLWEARKFELDRHEVILCTCSCAASASLKILDVRQILVDEAGMATEPETLIPLVQFPQAEKVVLLGDHKQLRPVVKNERLQNLGLDRSLFERYHEDAHMLDTQYRMHEGICAFPSVAFYKSKLKTWQGLRRPPSVLGHAGKESCPVIFGHVQGHERSLLVSTDEGNENSKANLEEVAEVVRITKQLTLGRTVEPQDIAVLTPYNAQASEISKALRREGIAGVAVSSITKSQGSEWRYVLVSTVRTCAKSDLDQRPTKSWLKKFLGFVVDPNQVNVAVTRAQEGLCLIGDHLLLRCCPLWRSLLDFCEAQQTLVPAGQVRVCRRPTMPS

SEQ ID NO: 2125 - protein, 377 aa, Homo sapiens
MSEVKSRKKSGPKGAPAAEPGKRSEGGKTPVARSSGGGGWADPRTCLSLLSLGTCLGLAWFVFQQSEKFAKVENQYQLLKLETNEFQQLQSKISLISEKLESTESILQEATSSMSLMTQFEQEVSNLQDIMHDIQNNEEVLTQRMQSLNEKFQNITDFWKRSLEEMNINTDIFKSEAKHIHSQVTVQINSAEQEIKLLTERLKDLEDSTLRNIRTVKRQEEEDLLRVEEQLGSDTKAIEKLEEEQHALFARDEDLTNKLSDYEPKVEECKTHLPTIESAIHSVLRVSQDLIETEKKMEDLTMQMFNMEDDMLKAVSEIMEMQKTLEGIQYDNSILKMQNELDILKEKVHDFIAYSSTGEKGTLKEYNIENKGIGGDF

SEQ ID NO: 2126 - protein, 312 aa, Homo sapiens
MSIEKFWDRSSARKEGAEVQIAATWRVSLRLWTLSPLLCREAALDPPPAWRLVPFPDAHPGFSLWLGTPTERAALAGAGATVGLGRRSDSLASCKAGAASPILGCRTRAECQSGCDMKRLAWSLFLSSFPRPSWTRSPCPTFQKAPLPPPRGHTASSPPPLVCGSARSPRGKQEGAGSRSGGQAGAVAPRPLRRAVPGAGAEGDGSAGGPRRGAGWGGAALRHAPAPAEARHAAAVRVLQVQPRGAPLRLGRRVHSPGARGRGARIVLVRGGYRHPQCPETQSVAAAPGARFSPGPGLHHRPSSMGRSLGSW

SEQ ID NO: 2127 - protein, 134 aa, Homo sapiens
MREPIYMHSTMVFLPWELHTKKGKMALLASNGCFIRCNEAGDIEAKSKTAGEEEMIKIRSCAERETKKKDDIPEEDKGNVKQCEINYVKKFQSFQEHKLKISKEDSKILKKAQKDGFLHETLLDRVAVIACLHL

SEQ ID NO: 2128 - protein, 272 aa, Homo sapiens
MQWNVPRTVSRLARRTCLEPHNAGLFGHCQNVKGPLLLYNAESKVVLVRGPQKQWLHLSAAQCVAKERRPLDAHPPQPGVLRHKQGKQHVSFRRVFSSSATAQGTPEKKEEPDPLQDKSISLYQRFKKTFRQYGKVLIPVHLITSGVWFGTFYYAALKGVNVVPFLELIGLPDSVVSILKNSQSGNALTAYALFKIATPARYTVTLGGTSVTVKYLRSHGYMSTPPPVKEYLQDRMEETKELITEKMEETKDRLTEKLQETKEKVSFKKKVE

SEQ ID NO: 2129 - protein, 109 aa, Homo sapiens
MSTSDLELLTSKMKYRFSSVVHNDVQAFFHLFTEFSNHLLCVEIGGFSGCFSEVNDLLKSLSKKFQLKSQKHKVQETTRRWIFSVFEILYFLLISFTHFNFTTANLLRY

SEQ ID NO: 2130 - protein, 555 aa, Homo sapiens
MVCRPVFPCRRRFCPRPFLVGLVVAICLFYQTLTLRGSRKLTAAAPGAVPHTSTETQASRCKKGFSQDKQCFLLSGNAQETRKVKESMETHFGSHGRRAILYRPPFYSKTELQLHQHILTQHGYTVVIAEERLNAGLGPGLLEQGDLGSWDLLICLSSKKAEGTPCISKEVMCQLGLHQKANRLPEIQQPLCRKEGLCQIVRRFPELQLPVSPSVCLDQGMQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKKAGVPQI

SEQ ID NO: 2131 - protein, 100 aa, Homo sapiens
MHLDLLQTFFVRCTTHFKTALQGSPMYSGGPRHTQAGDPSSLRSRWPQPDTSYPAESHNPSQKSPNTSADQRWGSQARSFTHNDRLLGDIAGPLFLSSPC

SEQ ID NO: 2132 - protein, 317 aa, Homo sapiens
MRALRLGAEDQPLPAWIPQLRAVYCRPIPARPACQAACPGCRRHAAGATHALGRCADSAGAAPRAAGGAGWRELGGLGSRGALRAELVREPGCGCCLTCALSEGQPCGIYTERCGSGLRCQPSPDEARPLQALLDGRGLCVNASAVSRLRAYLLPAPPAPGNASESEEDRSAGSVESPSVSSTHRVSDPKFHPLHSKIIIIKKGHAKDSQRYKVDYESQSTDTQNFSSESKRETEYGPCRREMEDTLNHLKFLNVLSPRGVHIPNCDKKGFYKKKQCRPSKGRKRGFCWCVDKYGQPLPGYTTKGKEDVHCYSMQSK

SEQ ID NO: 2133 - protein, 303 aa, Homo sapiens
MAGAACEPVARPSLTSISSGELRSLWTCDCELALLPLAQLLRLQPGAFQLSGDQLVVAGPGEPAAARGGFNVFGDGLVRLDGQLYRLSSYIKRYVELTNYCDYKDYRETILSKPMLFFINVQTKKDTSKERTYAFLVNTRHPKIRRQIEQGMDMVISSVIGESYRLQFDFQEAVKNFFPPGNEVVNGENLSFAYEFKADALFDFFYWFGLSNSVVKVNGKVLNLSSTSPEKKETIKLFLEKMSEPLIRRSSFSDRKFSVTSRGSIDDVFNCNLSPRSSLTEPLLAELPFPSVLESEETPNQFI

SEQ ID NO: 2134 - protein, 245 aa, Homo sapiens
MRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSILAQSCTEILELQPSSVCVGEEFQIVLSGRGFMLGSRNGSVLCTYTVNETYTTSVKPVSVQLNSMLCPAPILNKAGEWGLTVTQAGVKWHDLTHCTFGLSGSGDPPTSAS

SEQ ID NO: 2135 - protein, 276 aa, Homo sapiens [sequence omitted]

SEQ ID NO: 2136 - protein, 111 aa, Homo sapiens [sequence omitted]

SEQ ID NO: 2137 - protein, 129 aa, Homo sapiens
MSASLVRATVRAVSKRKLQPTRAALTLTPSAVNKIKQLLKDKPEHVGVKVGVRTRGCNGLSYTLEYTKTKGDSDEEVIQDGVRVFIEKKAQLTLLGTEMDYVEDKLSSEFVFNNPNIKGTCGCGESFNI

SEQ ID NO: 2138 - protein, 262 aa, Homo sapiens
MKRHEMVVAKHSALCSRFAQDLWLEQNIKDSFQKVTLSRYGKYGHKNLQLRKGCKSVDECKEHQGGYNGLNQCLKITTSKIFQCNKYVKVMHKFSNSNRHKIRHTENKHFRCKECDKSLCMLSRLTQHKKIHTRENFYKCEECGKTFNWSTNLSKPKKIHTGEKPYKCEVCGKAFHQSSILTKHKIIRTGEKPYKCAHCGKAFKQSSHLTRHKIIHTEEKPYKCEQCGKVFKQSPTLTKHQIIYTGEEPYKCEECGKAFNLS

SEQ ID NO: 2139 - protein, 415 aa, Homo sapiens
MGLGGVSREAGLLLLSSPCPDPSVCLSDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 2140 - protein, 133 aa, Homo sapiens
MMPRTGRSRWSPEDLHDGETALYDAVMVGASHSAFASTHRMYESEPQCKLQTGVATCVSTLALRPRLPDGSTLPAGLLRATSPVGRSPAAVGAPRTPPAGMTQKIRILMTSQREEELGSINQRKNLKIPIMFL

SEQ ID NO: 2141 - protein, 110 aa, Homo sapiens
MYFLKAKMFSFPVTQNYQTQELNTEFFLQHLTRIKVLVSDCFGGWGSTGSRWPDGLGGLPASDAGGQALPGSSSLPRFSCRPVVRPPGARGGGPPGFPACPSRAGLHFWR

SEQ ID NO: 2142 - protein, 374 aa, Homo sapiens [sequence omitted]

SEQ ID NO: 2143 - protein, 162 aa, Homo sapiens [sequence omitted]

SEQ ID NO: 2144 - protein, 353 aa, Homo sapiens
MAEMNPAQGHVVFEDVAIYFSQEEWGHLDEAQRLLYRDVMLENLALLSSLGCCHGAEDEEAPLEPGVSVGVSQVMAPKPCLSTQNTQPCETCSSLLKDILRLAEHDGTHPEQGLYTCPAHLHQHQKEQIREKLSRGDGGRPTFVKNHRVHMAGKTFLCSECGKAFSHKHKLSDHQKIHTGERTYKCSKCGILFMERSTLNRHQRTHTGERPYECNECGKAFLCKSHLVRHQTIHSGERPYECSECGKLFMWSSTLITHQRVHTGKRPYGCSECGKFFKCNSNLFRHYRIHTGKRSYGCSECGKFFMERSTLSRHQRVHTGERPYECNECGKFFSLKSVLIQHQRVYTEEESFQ

SEQ ID NO: 2145 - protein, 461 aa, Homo sapiens
MGTIHLFRKPQRSFFGKLLREFRLVAADRRSWKILLFGVINLICTGFLLMWCSSTNSIALTAYTYLTIFDLFSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGKVLLQTTPPHVIGQLDKLIREVSTLDGVLEVRNEHFWTLGFGSLAGSVHVRIRRDANEQMVLAHVTNRLYTLVSTLTVQIFKDDWIRPALLSGPVAANVLNFSDHHVIPMPLLKGTDDLNPVTSTPAKPSSPPPEFSFNTPGKNVNPVILLNTQTRPYGFGLNHGHTPYSSMLNQGLGVPGIGATQGLRTGFTNIPSRYGTNNRIGQPRP

SEQ ID NO: 2146 - protein, 306 aa, Homo sapiens
MSNVNLSVSDFWRVMMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQE

SEQ ID NO: 2147 - protein, 340 aa, Homo sapiens
MAKWLRDYLSFGGRRPPPQPPTPDYTESDILRAYRAQKNLDFEDPYEDAESRLEPDPAGPGDSKNPGDAKYGSPKHRLIKVEAADMARAKALLGGPGEELEADTEYLDPFDAQPHPAPPDDGYMEPYDAQWVMSELPGRGVQLYDTPYEEQDPETADGPPSGQKPRQSRVPQEDERPADEYDQPWEWKKDHISRAFAVQFDSPEWERTPGSAKELRRPPPRSPQPAERVDPALPLEKQPWFHGPLNRADAESLLSLCKEGSYLVRLSETSPQDCSLSLRSSQGFLHLKFARTRENQVVLGQHSGPFPSVPELVLHYSSRPLPVQGAEHLALLYPVVTQTP

SEQ ID NO: 2148 - protein, 144 aa, Homo sapiens
MNSLTVMRVWDHSSSVYLEPTSTGTVRQPAISWIYSKLAERHTLASSLLISVGHSTKCALHVVPFHPRKTSRAETRTVIPSFTDEEPAWRGGAPCSRLCGSYTVLCSFADRAGKSGWLGCSSSLLANSLLTSFFAHFVTKLRNL

SEQ ID NO: 2149 - protein, 199 aa, Homo sapiens
MASGSGTKNLDFRRKWDKDEYEKLAEKRLTEEREKKDGKPVQPVKRELLRHRDYKVDLESKLGKTIVITKTTPQSEMGGYYCNVCDCVVKDSINFLDHINGKKHQRNLGMSMRVERSTLDQVKKRFEVNKKKMEEKQKDYDFEERMKELREEEEKAKAYKKEKQKEKKRRAEEDLTFEEDDEMAAVMGFSGFGSTKKSY

SEQ ID NO: 2150 - protein, 491 aa, Homo sapiens
MKPGGFWLHLTLLGASLPAALGWMDPGTSRGPDVGVGESQAEEPRSFEVTRREGLSSHNELLASCGKKFCSRGSRCVLSRKTGEPECQCLEACRPSYVPVCGSDGRFYENHCKLHRAACLLGKRITVIHSKDCFLKGDTCTMAGYARLKNVLLALQTRLQPLQEGDSRQDPASQKRLLVESLFRDLDADGNGHLSSSELAQHVLKKQDLDEDLLGCSPGDLLRFDDYNSDSSLTLREFYMAFQVVQLSLAPEDRVSVTTVTVGLSTVLTCAVHGDLRPPIIWKRNGLTLNFLDLEDINDFGEDDSLYITKVTTIHMGNYTCHTSGHEQLFQTHVLQVNVPPVIRVYPESQAQEPGVAASLRCHAEGIPMPRITWLKNGVDVSTQMSKQLSLLANGSELHISSVRYEDTGAYTCIAKNEVGVDEDISSLFIEDSARKTLANILWREEGLSVGNMFYVFSDDGIIVIHPVDCEIQRHLKPTEKIFMSYEEICP

SEQ ID NO: 2151 - protein, 193 aa, Homo sapiens [sequence omitted]

SEQ ID NO: 2152 - protein, 304 aa, Homo sapiens
MPSPSPKGLPVKQYAVQSQLPVYEWPDVGSGEYDVGVVASFGRLLNEALILKFPYGILNVHPSCLPRWRGPAPVIHTVLHGDTVTGVTIMQIRPKRFDVGPILKQETVPVPPKSTAKELEAVLSRLGANMLISVLKNLPESLSNGRQQPMEGATYAPKISAGTSCIKWEEQTSEQIFRLYRAIGNIIPLQTLWMANTIKLLDLVEVNSSVLADPKLTGQALIPGSVIYHKQSQILLVYCKDGWIGVRSVMLKKSLTATDFYNGYLHPWYQKNSQAQPSQCRFQTLRLPTKKKQKKTVAMQQCIE

SEQ ID NO: 2153 - protein, 101 aa, Homo sapiens
MLSRLMSKCWWFLLLLCCSMKALPGCLEGCAFPGQCQLGCPRPCTVPIAIAGPSPGHAGASAGAAGLSRQHSAHAERTRPCFSCAEKLLGYLIFPMCFHNS

SEQ ID NO: 2154 - protein, 367 aa, Homo sapiens
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 2155 - protein, 420 aa, Homo sapiens
MAGVEEVAASGSHLNGDLDPDDREEGAASTAEEAAKKKRRKKKKKKKKRGPKVQTDPPPVPICDLYPNGVFPKGQECEYPPTQDGRTAAWRTTSEEKKALDQASEEIWNDFREAAEAHRQVRKYVMSWIKPGMTMIEICEKLEDCSRKLIKENGLNAGLAFPTGCSLNNCAAHYTPNAGDTTVLQYDDICKIDFGTHISGRIIDCAFTVTFNPKYDTLLKAVKDATNTGIKCAGIDVRLCDVGEAIQEVMESYEVEIDGKTYQVRPIRNLNGHSIGQYRIHAGKTVPIVKGGEATRMEEGEVYAIETFGSTGKGVVHDDMECSHYMKNFDVGHVPIRLPRTKHLLNVINENFGTLAFCRRWLDRLGESKYLMALKNLCDLGIVDPYPPLCDIKGSYTAQFEHTILLRPTCKEVVSRGDDY

SEQ ID NO: 2156 - protein, 133 aa, Homo sapiens
MAELFLELVYSIHRKHRSCLIYGGTPSQNLPVITCAAYYFAMASSQRMKEGHIVLKLSAVFQPPQGHGCGGLFQTDLRAQVEPAISHSTEGLSKRFSARYTAVVNSQALESDCLIPTITSLVGDYAAHKYRLV

SEQ ID NO: 2157 - protein, 130 aa, Homo sapiens
MPAYWRPSNRVANHVLSRLSGRPGSYSATSRPRLFPVRGSCHFRLFPPRVPISCVCSRVPEPAPEMSTRGFRVGTNLERQWPALSGLRWLLRLGLLLRLQGRPLHGFLPSQVSRGQLLPGGARNRILSAY

SEQ ID NO: 2158 - protein, 680 aa, Homo sapiens
MDEEEDNLSLLTALLEENESALDCNSEENNFLTRENGEPDAFDELFDADGDGESYTEEADDGETGETRDEKENLATLFGDMEDLTDEEEVPASQSTENRVLPAPAPRREKTNEELQEELRNLQEQMKALQEQLKVTTIKQTASPARLQKSPVEKSPRPPLKERRVQRIQESTCFSAELDVPALPRTKRVARTPKPSPPDPKSSSSRMTSAPSQPLQTISRNKPSGITRGQIVGTPGSSGETTQPICVEAFSGLRLRRPRVSSTEMNKKMTGRKLIRLSQIKEKMAREKLEEIDWVTFGVILKRVTPQSVNSGKTFSIWKLNDLRDLTQCVSLFLFGEVHKALWKTEQGTVVGILNANPMKPKDGSEEVCLSIDHPQKVLIMGEALDLGTCKAKKKNGEPCTQTVNLRDCEYCQYHVQAQYKKLSAKRADLQSTFSGGRIPKKFARRGTSLKERLCQDGFYYGGVSSASYAASIAAAVAPKKKIQTTLSNLVVKGTNLIIQETRQKLGIPQKSLSCSEEFKELMDLPTCGARNLKQHLAKATASGIMGSPKPAIKSISASALLKQQKQRMLEMRRRKSEEIQKRFLQSSSEVESPAVPSSSRQPPAQPPRTGSEFPRLEGAPATMTPKLGRGVLEGDDVLFYDESPPPRPKLSALAEAKKLAAITKLRAKGQVLTKTNPNS

SEQ ID NO: 2159 - protein, 102 aa, Homo sapiens [sequence omitted]

SEQ ID NO: 2160 - protein, 251 aa, Homo sapiens
MAIAGIMLLLRSIRLTSKFTSSSDIPVEFIRRNVKLRGRLRRITENGLEIEHIPITLPIIASLRKEPRGALLVKLAGVELAETGKAWLQKELKPSQLLWFQLLGKENSALFCYLLVSKGGYFSVNLNEEILRRGLGKTVLVKGLKYDSKIYWTVHRNLLKAELTALKKGEGIWKEDSEKESYLEKFKDSWREIWKKDSFLKTTGSDFSLKKESYYEKLKRTYEIWKDNMNNCSLILKFRELISRINFRRKG

SEQ ID NO: 2161 - protein, 481 aa, Homo sapiens [sequence omitted]

SEQ ID NO: 2162 - protein, 211 aa, Homo sapiens
MCPGNWLWASMTFMARFSRSSSRSPVRTRGTLEEMPTVQHPFLNVFELERLLYTGKTACNHADEVWPGLYLGDQDMANNRRELRRLGITHVLNASHSRWRGTPEAYEGLGIRYLGVEAHDSPAFDMSIHFQTAADFIHRALSQPGGKILVHCAVGVSRSATLVLAYLMLYHHLTLVEAIKKVKDHRGIIPNRGFLRQLLALDRRLRQGLEA

SEQ ID NO: 2163 - protein, 372 aa, Homo sapiens
MASSASARTPAGKRVINQEELRRLMKEKQRLSTSRKRIESPFAKYNRLGQLSCALCNTPVKSELLWQTHVLGKQHREKVAELKGAKEASQGSSASSAPQSVKRKAPDADDQDVKRAKATLVPQVQPSTSAWTTNFDKIGKEFIRATPSKPSGLSLLPDYEDEEEEEEEEEGDGERKRGDASKPLSDAQGKEHSVSSSREVTSSVLPNDFFSTNPPKAPIIPHSGSIEKAEIHEKVVERRENTAEALPEGFFDDPEVDARVRKVDAPKDQMDKEWDEFQKAMRQVNTISEAIVAEEDEEGRLDRQIGEIDEQIECYRRVEKLRNRQDEIKNKLKEILTIKELQKKEEENADSDDEGELQDLLSQDWRVKGALL

SEQ ID NO: 2164 - protein, 406 aa, Homo sapiens
MDQSGMEIPVTLIIKAPNQKYSDQTISCFLNWTVGKLKTHLSNVYPSKPLTKDQRLVYSGRLLPDHLQLKDILRKQDEYHMVHLVCTSRTPPSSPKSSTNRESHEALASSSNSSSDHSGSTTPSSGQETLSLAVGSSSEGLRQRTLPQAQTDQAQSHQFPYVMQGNVDNQFPGQAAPPGFPVYPAFSPLQMLWWQQMYAHQYYMQYQAAVSAQATSNVNPTQPTTSQPLNLAHVPGEEPPPAPNLVAQENRPMNENVQMNAQGGPVLNEEDFNRDWLDWMYTFSRAAILLSIVYFYSSFSRFIMVMGAMLLVYLHQAGWFPFRQEGGHQQAPNNNAEVNNDGQNANNLELEEMERLMDDGLEDESGEDGGEDASAIQRPGLMASAWSFITTFFTSLIPEGPPQVAN

SEQ ID NO: 2165 - protein, 186 aa, Homo sapiens
MMYPVRGTEGSTVLCVSKMEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNRNAASPTSVRKRRPWWAAGCPLPLWLRLTVSISP

SEQ ID NO: 2166 - protein, 174 aa, Homo sapiens
MATVAELKAVLKDTLEKKGVLGHLKARIRAEVFNALDDDREPRPSLSHENLLINELIREYLEFNKYKYTASVLIAESGQPVVPLDRQFLIHELNAFEESKDNTIPLLYGILAHFLRGTKDGIQNAFLKGPSLQPSDPSLGRQPSRRKPMDDHLRKEEQKSTNIEDLHVSQAVNR

SEQ ID NO: 2167 - protein, 114 aa, Homo sapiens
MGSLSSLKTHFPPCPRHKFILMLILQSLRYHASYRDILDDLLHQDRIGQHMSPEGCMLKQQSKQLAHNRQLLRPNSVHPQALQHQPEDSRQESQDGDTDPPQLVPTITETEMSQ

SEQ ID NO: 2168 - protein, 295 aa, Homo sapiens
MRHSVARPTRLPRRLSPFWDPATCKNLEGGAGEVVRGRDPRRLRTSRSTEILGEGLAGPSAGAAARPAAPPPQPREPGAPGLRRAPPRTRMDSSGLGPCSEAPLHTSAGLSGRNLRAAGGVLPVDLERERAALCARQSGHGPPAVRWLLGSRGAESGGLARRRVAAEHAQPSANLVCRSALETSAFPPSKPKSPRGRVRARSSDGRLRHPAWRAGSGGRGGRGPSAELASRYWGRRRALPGAADLRPKGARADDRRPLRAGRKLHLPEAARLPGNVGKSGEPHKAGEVGNHPRDS

SEQ ID NO: 2169 - protein, 105 aa, Homo sapiens
MCSEHSINIWLMEFPPSMSLTAECLPNPCPSSLTLFPTLQTSTEDTTAPSLSLFSSLRHHPPCISLHSLPTPALQDPAYHNSQLAGWSHCGFLGSLQGWKAHVST

SEQ ID NO: 2170 - protein, 148 aa, Homo sapiens
MRRLSIVMKNPWHSPHPQTHGSHSHTGPKATVSAAVAPVDIGKPGEGVEEISWPPAGSLGFCAQGSWSPKNFQKLTPHVPILLGFLDFSEAPAEGSRCSLECRGSPLTWLLESLLFLLLLPSSSSSSLSISPSLCPSPVPDLAIPGCP

SEQ ID NO: 2171 - protein, 513 aa, Homo sapiens
MSYGSIARGGGLGSRGPLGGPSRQGCQPLECARCWTEYGIRHFPCPSPESKLQNPCVGKDGEGDLGPAGTPIVPRARKRGPGVAPEGSRMPEPTSSPTIGPRKDSAAGPHGRMAGPSATRAKKRKPNFCPQETEVLVSKVSKHHQLLFGTGLLKAEPTRRYRVWSRILQAVNALGYCRRDVVDLKHKWRDLRAVVRRKLGDLRKAAHGPSPGSGKPQALALTPVEQVVAKTFSCQALPSEGFSLEPPRATQVDPCNLQELFQEMSANVFRINSSVTSLERSLQSLGTPSDTQELRDSLHTAQQETNKTIAASASSVKQMAELLRSSCPQERLQQERPQLDRLKTQLSDAIQCYGVVQKKIAEKSRALLPMAQRGSKQSPQAPFAELADDEKVFNGSDNMWQGQEQALLPDITEEDLEAIRLREEAILQMESNLLDVNQIIKDLASMVSEQGEAVDSIEASLEAASSHAEAARQLLAGASRHQLQRHKIKCCFLSAGVTALLVIIIIIATSVRK

SEQ ID NO: 2172 - protein, 163 aa, Homo sapiens
MSWRPQPCCISSCCLTTDWVHLWYIWLLVVIGALLLLCGLTSLCFRCCCLSRQQNGEDGGPPPCEVTVIAFDHDSTLQSTITSLQSVFGPAARRILAVAHSHSSLGQLPSSLDTLPGYEEALHMSRFTVAMCGQKAPDLPPVPEEKQLPPTEKESTRIVDSWN

SEQ ID NO: 2173 - protein, 158 aa, Homo sapiens
MDPGDDWLVESLRLYQDFYAFDLSGATRVLEWIDDKGVFVAGYESLKKNEILHLKLPLRLSVKENKGLFPERDFKVRHGGFSDRSIFDLKHVPHTRYGQFCDPAIHTGWDGMAANAWGYSASSSPFPPPQHTGTCECTSVCTQIHTDLEYKETTAVAS

SEQ ID NO: 2174 - protein, 212 aa, Homo sapiens
MSRSPLNPSQLRSVGSQDALAPLPPPAPQNPSTHSWDPLCGSLPWGLSCLLALQLLASSFFSCGMSTILQTWMGSRLPLVQAPSLEFLIPALVLTSQKLPRAIQTPGNSSLMLHLCRGPSCHGLGHWNTSLQEVSGAVVVSGLLQGMMGLLGSPGHVFPHCGPLVLAPSLVVAGLSAHREVAQFCFTHWGLALLYVSPERRGMVPSGGVWGD

SEQ ID NO: 2175 - protein, 167 aa, Homo sapiens [sequence omitted]

SEQ ID NO: 2176 - protein, 509 aa, Homo sapiens
MLENYRNLLSLAEPKPEIYTCSSCLLAFSCQQFLSQHVLQIFLGLCAENHFHPGNSSPGHWKQQGQQYSHVSCWFENAEGQERGGGSKPWSARTEERETSRAFPSPLQRQSASPRKGNMVVETEPSSAQRPNPVQLDKGLKELETLRFGAINCREYEPDHNLESNFITNPRTLLGKKPYICSDCGRSFKDRSTLIRHHRIHSMEKPYVCSECGRGFSQKSNLSRHQRTHSEEKPYLCRECGQSFRSKSILNRHQWTHSEEKPYVCSECGRGFSEKSSFIRHQRTHSGEKPYVCLECGRSFCDKSTLRKHQRIHSGEKPYVCRECGRGFSQNSDLIKHQRTHLDEKPYVCRECGRGFCDKSTLIIHERTHSGEKPYVCGECGRGFSRKSLLLVHQRTHSGEKHYVCRECRRGFSQKSNLIRHQRTHSNEKPYICRECGRGFCDKSTLIVHERTHSGEKPYVCSECGRGFSRKSLLLVHQRTHSGEKHYVCRECGRGFSHKSNLIRHQRTH

SEQ ID NO: 2177 - protein, 430 aa, Homo sapiens
MPAPALPTSAMAVQVPLWHHYLQAIRSREAPRAQDFQRAENVLLTVLERVHALDPRFIVDYSRGLEAFQFALRSSEDPMDMEVPLWVDAEALLIEEPEATQPEDGLELCHLGVPREGAGLERWTTEDTFTASSEGDAKCRGHIVPSKVLCVLKDLLVAAIVHCKHHSLIAPGSLNAASLREEQLHLSLLVSSGWRTISFHVVPVVRRKLGAPALEGVQQMPGFPEGNLRRILSQGVDLVPASAQLWRTSTDYLLTRLLGELGSLQGHRLDSLSILDRVNHESWRDSGQTDGLTFGHLKMVLLWASVLFPAPEDWAELQGAVYRLLVVLLCCLATRKLPPAAHRLRAELGHLVSATCSWLPNRLCTAPWEAPGMFGRRNGLLLEGVVEGFCPQQWPLRVFQCLVGQGRPLGAPPPWVRAWMQVPSSPCGAC

SEQ ID NO: 2178 - protein, 350 aa, Homo sapiens [sequence omitted]

SEQ ID NO: 2179 - protein, 332 aa, Homo sapiens [sequence omitted]

SEQ ID NO: 2180 - protein, 140 aa, Homo sapiens [sequence omitted]

SEQ ID NO: 2181 - protein, 101 aa, Homo sapiens
MLKFLFFFFFFFFFEMESHSVAHAGVQWHDLSSLQPPPPGFKRFSCLSLLSSWDYRCAPPHPANFCIFSRDRVSPCCSGWSQTPDLVIRLPRPPKVLGLQA

SEQ ID NO: 2182 - protein, 126 aa, Homo sapiens [sequence omitted]

SEQ ID NO: 2183 - protein, 106 aa, Homo sapiens
MTPPWATTHSCTRQEQTRMVYSLSLQGWCAGQASYTPQVCARPGTSQSLGGEVLGQCGMEEEGGKLSVGSSYWRGGDGHGTKTQMGKCEKAEISKELRWRPTEEEC

SEQ ID NO: 2184 - protein, 126 aa, Homo sapiens [sequence omitted]

SEQ ID NO: 2185 - protein, 341 aa, Homo sapiens
MAKGLLVTYALWAVGGPAGLHHLYLGRDSHALLWMLTLGGGGLGWLWEFWKLPSFVAQANRAQGQRQSPRGVTPPLSPIRFAAQVIVGIYFGLVALISLSSMVNFYIVALPLAVGLGVLLVAAVGNQTSDFKNTLGSAFLTSPIFYGRPIAILPISVAASITAQRHRRYKALVASEPLSVRLYRLGLAYLAFTGPLAYSALCNTAATLSYVAETFGSFLNWFSFFPLLGRLMEFVLLLPYRIWRLLMGETGFNSSCFQEWAKLYEFVHSFQDEKRQLAYQVLGLSEGATNEEIHRSYQELVKVWHPDHNLDQTEEAQRHFLEIQAAYEVLSQPRKPWGSRR

SEQ ID NO: 2186 - protein, 434 aa, Homo sapiens
MEGAELAGKILSTWLTLVLGFILLPSVFGVSLGISEIYMKILVKTLEWATIRIEKGTPKESILKNSASVGIIQRDESPMEKGLSGLRGRDFELSDVFYFSKKGLEAIVEDEVTQRFSSEELVSWNLLTRTNVNFQYISLRLTMVWVLGVIVRYCVLLPLRVTLAFIGISLLVIGTTLVGQLPDSSLKNWLSELVHLTCCRICVRALSGTIHYHNKQYRPQKGGICVANHTSPIDVLILTTDGCYAMVGQVHGGLMGIIQRAMVKACPHVWFERSEMKDRHLVTKRLKEHIADKKKLPILIFPEGTCINNTSVMMFKKGSFEIGGTIHPVAIKYNPQFGDAFWNSSKYNMVSYLLRMMTSWAIVCDVWYMPPMTREEGEDAVQFANRVKSAIAIQGGLTELPWDGGLKRAKVKDIFKEEQQKNYSKMIVGNGSLS

SEQ ID NO: 2187 - protein, 278 aa, Homo sapiens
MTSEKHLLATGPRQCVGQTERRSQSDTAVNVTTRKVSAPDILKPLNQEDPKCSTNPILKQQNLPSSPAPSTIFSGGFRHGSLISIDSTCTEMGNFDNANVTGEIEFAIHYCFKTHSLEICIKACKNLAYGEEKKKKCNPYVKTYLLPDRSSQGKRKTGVQRNTVDPTFQETLKYQVAPAQLVTRQLQVSVWHLGTLARRVFLGEVIIPLATWDFEDSTTQSFRWHPLRAKAEKYEDSVPQSNGELQSGLSWFSLHGPENSKRLKKGQISHHFMVNFVW

SEQ ID NO: 2188 - protein, 982 aa, Homo sapiens
MSSKMVISEPGLNWDISPKNGLKTFFSRENYKDHSMAPSLKELRVLSNRRIGENLNASASSVENEPAVSSATQAKEKVKTTIGMVLLPKPRVPYPRFSRFSQREQRSYVDLLVKYAKIPANSKAVGINKNDYLQYLDMKKHVNEEVTEFLKFLQNSAKKCAQDYNMLSDDARLFTEKILRACIEQVKKYSEFYTLHEVTSLMGFFPFRVEMGLKLEKTLLALGSVKYVKTVFPSMPIKLQLSKDDIATIETSEQTAEAMHYDISKDPNAEKLVSRYHPQIALTSQSLFTLLNNHGPTYKEQWEIPVCIQVIPVAGSKPVKVIYINSPLPQKKMTMRERNQIFHEVPLKFMMSKNTSVPVSAVFMDKPEEFISEMDMSCEVNECRKIESLENLYLDFDDDVTELETFGVTTTKVSKSPSPASTSTVPNMTDAPTAPKAGTTTVAPSAPDISANSRSLSQILMEQLQKEKQLVTGMDGGPEECKNKDDQGFESCEKVSNSDKPLIQDSDLKTSDALQLENSQEIETSNKNDMTIDILHADGERPNVLENLDNSKEKTVGSEAAKTEDTVLCSSDTDEECLIIDTECKNNSDGKTAVVGSNLSSRPASPNSSSGQASVGNQTNTACSPEESCVLKKPIKRVYKKFDPVGEILKMQDELLKPISRKVPELPLMNLENSKQPSVSEQLSGPSDSSSWPKSGWPSAFQKPKGRLPYELQDYVEDTSEYLAPQEGNFVYKLFSLQDLLLLVRCSVQRIETRPRSKKRKKIRRQFPVYVLPKVEYQACYGVEALTESELCRLWTESLLHSNSSFYVGHIDAFTSKLFLLEEITSEELKEKLSALKISNLFNILQHILKKLSSLQEGSYLLSHAAEDSSLLIYKASDGKVTRTAYNLYKTHCGLPGVPSSLSVPWVPLDPSLLLPYHIHHGRIPCTFPPKSLDTTTQQKIGGTRMPTRSHRNPVSMETKSSCLPAQQVETEGVAPHKRKIT

SEQ ID NO: 2189 - protein, 172 aa, Homo sapiens [sequence omitted]

SEQ ID NO: 2190 - protein, 401 aa, Homo sapiens
MEPRRAAPGVPGWGSREAAGSASAAELVYHLAGALGTELQDLARRFGPEAAAGLVPLVVRALELLEQAAVGPAPDSLQVSAQPAEQELRRLREENERLRRELRAGPQEERALLRQLKEVTDRQRDELRAHNRDLRQRGQETEALQEQLQRLLLVNAELRHKLAAMQTQLRAAQDRERERQQPGEAATPQAKERARGQAGRPGHQHGQEPEWATAGAGAPGNPEDPAEAAQQLGRPSEAGQCRFSREEFEQILQERNELKAKVFLLKEELAYFQRELLTDHRVPGLLLEAMKVAVRKQRKKIKAKMLGTPEEAESSEDEAGPWILLSDDKGDHPPPPESKIQSFFGLWYRGKAESSEDETSSPAPSKLGGEEEAQPQSPAPDPPCSALHEHLCLGASAAPEA

SEQ ID NO: 2191 - protein, 337 aa, Homo sapiens [sequence omitted]

SEQ ID NO: 2192 - protein, 295 aa, Homo sapiens
MDSLQDTVALDHGGCCPALSRLAPRGFGTEMWTLFALSGPLFLFQVLTFMIYIVSTVFCGHLGKVELASVTLAVAFVNVCGVSVGVGLSSACGTLMSQSFGSPNKKHVGVILQRGALVLLLCCLPCWALFLNTQHILLLFRQDPDVSRLTQDYVMIFIPGLPVIFLYNLLAKYLQNQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMEHAQCGGSLCPGCHL

SEQ ID NO: 2193 - protein, 171 aa, Homo sapiens
MPWGELRSPIFLPTPPPRKLSGLGSKQVCSRGCRLGHLAAPGAACMLPWRQAPGLVARRQSPKALPIQGREQLEPQALQSSLPDHPGAHRSPGACPEGFPGQREGGGARVGRGWGRGSGRGRGSGRGRGSGRGRGSGRADLGTGAGKLLQGFQVRRKAFPGASLPGQGLGE

SEQ ID NO: 2194 - protein, 425 aa, Homo sapiens
MADMEDLFGSDADSEAERKDSDSGSDSDSDQENAASGSNASGSESDQDERGDSGQPSNKELFGDDSEDEGASHHSGSDNHSERSDNRSEASERSDHEDNDPSDVDQHSGSEAPNDDEDEGHRSDGGSHHSEAEGSEKAHSDDEKWGREDKSDQSDDEKIQNSDDEERAQGSDEDKLQNSDDDEKMQNTDDEERPQLSDDERQQLSEEEKANSDDERPVASDNDDEKQNSDDEEQPQLSDEEKMQNSDDERPQASDEEHRHSDDEEEQDHKSESARGSDSEDEVLRMKRKNAIASDSEADSDTEVPKDNSGTMDLFGGADDISSGSDGEDKPPTPGQPVDENGLPQDQQEEEPIPETRIEVEIPKVNTDLGNDLYFVKLPNFLSVEPSMSLHLGNEVFDVYKAPLQGDHNHLFYKTRYWSTGTSSL

SEQ ID NO: 2195 - protein, 316 aa, Homo sapiens
MAVWSPLVMPGRREGCCHTPVTNEETEAREAKGQKLRPCHTLGVHVCLSLFRSELLGLLKTYNCYHEGKSFQLRHREEEGTLIIEGLLNIAWGLRRPIRLQMQDDREQVHLPSTSWMPRRPSCPLKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFV

SEQ ID NO: 2196 - protein, 532 aa, Homo sapiens
MAPSFTARIQLFLLRALGFLIGLVGRAALVLGGPKFASKTPRPVTEPLLLLSGMQLAKLIRQRKVKCIDVVQAYINRIKDVNPMINGIVKYRFEEAMREAHAVDQKLAEKQEDEATLENKWPFLGVPLTVKEAFQLQGMPNSSGLMNRRDAIAKTDATVVALLKGAGAIPLGITNCSELCMWYESSNKIYGRSNNPYDLQHIVGGSSGGEGCTLAAACSVIGVGSDIGGSIRMPAFFNGIFGHKPSPGVVPNKGQFPLAVGAQELFLCTGPMCRYAEDLAPMLKVMAGPGIKRLKLDTKVHLKDLKFYWMEHDGGSFLMSKVDQDLIMTQKKVVVHLETILGASVQHVKLKKMKYSFQLWIAMMSAKGHDGKEPVKFVDLLGDHGKHVSPLWELIKWCLGLSVYTIPSIGLALLEEKLRYSNEKYQKFKAVEESLRKELVDMLGDDGVFLYPSHPTVAPKHHVPLTRPFNFAYTGVFSALGLPVTQCPLGLNAKGLPLGIQVVAGPFNDHLTLAVAQYLEKTFGGWVCPGKF

SEQ ID NO: 2197 - protein, 101 aa, Homo sapiens
MTDGRWLRRSWRGDGQCHDTGHQPGPAALTPQDQAPLAPALAQPRYLDTDNLSPTKETRAGIGANLSSASGHWVLGSQLFQRLGQLPGLLRLPALFNKTRK

SEQ ID NO: 2198 - protein, 121 aa, Homo sapiens [sequence omitted]

SEQ ID NO: 2199 - protein, 652 aa, Homo sapiens
MTSASPEDQNAPVGCPKGARRRRPISVIGGVSLYGTNQTEELDNLLTQPASRPPMPAHQVPPYKAVSARFRPFTFSQSTPIGLDRVGRRRQMRASNVSSDGGTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIEDIYKFQRKFLKDLEKQYNKEEPHLSEIGSCFLQNQEGFAIYSEYCNNHPGACLELANLMKQGKYRHFFEACRLLQQMIDIAIDGFLLTPVQKICKYPLQLAELLKYTTQEHGDYSNIKAAYEAMKNVACLINERKRKLESIDKIARWQVSIVGWEGLDILDRSSELIHSGELTKITKQGKSQQRTFFLFDHQLVSCKKDLLRRDMLYYKGRLDMDEMELVDLGDGRDKDCNLSVKNAFKLVSRTTDEVYLFCAKKQEDKARWLQACADERRRVQEDKEMGMEISENQKKLAMLNAQKAGHGKSKGYNRCPVAPPHQGLHPIHQRHITMPTSVPQQQVFGLAEPKRKSSLFWHTFNRLTPFRK

SEQ ID NO: 2200 - protein, 115 aa, Homo sapiens [sequence omitted]

SEQ ID NO: 2201 - protein, 201 aa, Homo sapiens [sequence omitted]

SEQ ID NO: 2202 - protein, 221 aa, Homo sapiens
MTSVLPSASASREDFVICSICLFCFQVCMLCSVGYHLFSCHRSEKTCRRWMALDYAGISIGILGCYVSGVFYAFYCNNYWRQVYLITVLAMILAVFFAQIHPNYLTQQWQRLRSIIFCSVSGYGVIPTLHWVWLNGGIGAPIVQDFAPRVIVMYMIALLAFLFYISKVPERYFPGQLNYLGSSHQIWHILAVVMLYWWHQSTVYVMQYRHSKPCPDYVSHL

SEQ ID NO: 2203 - protein, 333 aa, Homo sapiens
MSAKLGKSSSLLTQTSEECNGILTEKMEEEEQTCDPDSSLHWSSSYSPETFRQQFRQFGYQDSPGPHEALSRLWELCHLWLRPEVHTKEQILELLVLEQFLAILPKELQAWVQKHHPENGEETVTMLEDVERELDGPKQIFFGRRKDMIAEKLAPSEITEELPSSQLMPVKKQLQGASWELQSLRPHDEDIKTTNVKSASRQKTSLGIELHCNVSNILHMNGSQSSTYRGTYEQDGRFEKRQGNPSWKKQQKCDECGKIFSQSSALILHQRIHSGKKPYACDECAKAFSRSAILIQHRRTHTDSKYEHAIAEAQKNMYFKTRLKCPRSLSGGR

SEQ ID NO: 2204 - protein, 102 aa, Homo sapiens [sequence omitted]

SEQ ID NO: 2205 - protein, 423 aa, Homo sapiens
MPQATSPPLWPLSLHGGKGILWARHSHPPGPPSHHIQDSGRCSLPLPQSPGVTPLPARLSGATPLSPIRLLSSFVPRGPRVIPLTNQARRTLHASLGGCWGRTSDAADTASLKAWQGGTLGRHLQGPHLTSPQPQEADPSSWSPSRVGGMVASVSWALGPPHCEEEVWALWEVSSRGHADLGSESWCPLLLPSHFSSESWCPLLLPSHFSTGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGDIKDVRLDGESQ

SEQ ID NO: 2206 - protein, 1113 aa, Homo sapiens
MLQSALLSTRKHLYGLFHYNPMMLGLESLPDPTDTWEIIETIGKGTYGKVYKVTNKRDGSLAAVKILDPVSDMDEEIEAEYNILQFLPNHPNVVKFYGMFYKADHCVGGQLWLVLELCNGGSVTELVKGLLRCGQRLDEAMISYILYGALLGLQHLHNNRIIHRDVKGNNILLTTEGGVKLVDFGVSAQLTSTRLRRNTSVGTPFWMAPEVIACEQQYDSSYDARCDVWSLGITAIELGDGDPPLFDMHPVKTLFKIPRNPPPTLLHPERWCEEFNHFISQCLIKDFERRPSVTHLLDHPFIKGVHGKVLFLQKQLAEVLQDQKHQNPVAKTRHERMHTRRPYHVEDAEKYCLEDDLVNLEVLDEDTIIHQLQKRYADLLIYTYVGDILIALNPFQNLSIYSPQFSRLYHGVKRASNPPHIFASADAAYQCMVTLSKDQCIVISGESGSGKTESAHLIVQHLTFLGKANNQTLREKILQVNSLVEAFGNSCTAINDNSSRFGKYLEMMFTPTGVVMGARISEYLLEKSRVIKQAAREKNFHIFYYIYAGLHHQKKLSDFRLPEEKPPRYIADETGRVMHDIASKESYRRQFEAIQHCFRIIGFTDKEVHSVYRILAGILNIGNIEFAAISSQHQTDKSEVPNAEALQNAASVLCISPEELQEALTSHCVVTRGETIIRANTVDRAADVRDAMSKALYGRLFSWIVNRINTLLQPDENICSAGGGMNVGILDIFGFENFQRNSFEQLCINIANEQIQYYFNQHVFALEQMEYQNEGIDAIPVGYEDNRPLLDMFLQKPLGLLALLDEESRFPQATDQTLVDKFEDNLRCKYFWRPKGVELCFGIQHYAGKVLYDASGVLEKNRDTLPADVVVVLRTSENKLLQQLFSIPLTKTGNLAQTRARITVASSSLPPHFSAGKAKVDTLEVIRHPEETTNMKRQTVASYFRYSLMDLLSKMVVGQPHFVRCIKPNDDREALQFSRERVLAQLRSTGILETVSIRRQGYSHRILFEEFVKRYYYLAFTAHQTPLASKESCVAILEKSRLDHWVLGKTKVFLKYYHVEQLNLLLREVIGRVVVLQAYTKGWLGARRYNKVREKREKGAIAIQSAWRGYDAR

SEQ ID NO: 2207 - protein, 134 aa, Homo sapiens
MFLSPQCKRAACFLSAGSVGSEPGPSVQCLCTQIIACVTEDSVLSCHLLPSCCPVPGRTRMPPSLSGPWQSLRPGSEGRGRGPAGRRGLGAPDTLAPREGAGVRWSARAGGPLVSGLGTAGTATPAATPVPTVG

SEQ ID NO: 2208 - protein, 132 aa, Homo sapiens
MGVSLHCPDWSQTPGIRWSSCLGLPKCWDYSDQWRKCFMVDMGNWPDQLLSPSKTQTGRRNAREAADSPATEPEWSRGGPLSATGQVSGWGRGRLHQKAGAGSTRRRGQTTGQGGDESVAPPGSLPDLPQSF

SEQ ID NO: 2209 - protein, 134 aa, Homo sapiens
MSVNMDELKHQVMINQFVLTAGCAADQAKQLLQAAHWQFEVRGAGAGRGPGPRAECVPRGRRAGADGVDACRLCAPSGPQTRPAFPTAVPGVRIPRARGGRRWEPGHRSGIRRPRGAASPPGSRRGPPPPLLSG

SEQ ID NO: 2210 - protein, 695 aa, Homo sapiens [sequence omitted]

SEQ ID NO: 2211 - protein, 513 aa, Homo sapiens
MTGKLGFIAGVINRERMASFERLLWRICRGNVYLKFSEMDAPLEDPVTKEEIQKNIFIIFYQGEQLRQKIKKICDGFRATVYPCPEPAVERREMLESVNVRLEDLITVITQTESHRQRLLQEAAANWHSWLIKVQKMKAVYHILNMCNIDVTQQCVIAEIWFPVADATRIKRALEQGMELSGSSMAPIMTTVQSKTAPPTFNRTNKFTAGFQNIVDAYGVGSYREINPAPYTIITFPFLFAVMFGDCGHGTVMLLAALWMILNERRLLSQKTDNEIWNTFFHGRYLIHFINMFLFNYSDSSNAPLYKHQQEVQSFFVVMALISVPWMLLIKPFILRASHRKSQLQASRIQEDATENIEGDSSSPSSRSGQRTSADTHGALDDHGEEFNFGDVFVHQAIHTIEYCLGCISNTASYLRLWALSLAHAQLSEVLWTMVMNSGLQTRGWGGIVGVFIIFAVFAVLTVAILLIMEGLSAFLHALRLHWVEFQNKFYVGDGYKFSPFSFKHILDGTAEE

SEQ ID NO: 2212 - protein, 166 aa, Homo sapiens [sequence omitted]

SEQ ID NO: 2213 - protein, 291 aa, Homo sapiens
MARACLIQRLPIKRDCTPVFVRGLSSPSAAMALLSEGLDEVPAACLSPCGPPNPTELFSESRRLALEELVAGGPEAFAAFLRRERLARFLNPDEVHAILRAAERPGEEGAAAAAAAEDSFGSSHDCSSGTYFPEQSDLEPPLLELGWPAFYQGAYRGATRVETHFQPRGAGEGGPYGCKDALRQQLRSAREVIAVVMDVFTDIDIFRDLQEICRKQGVAVYILLDQALLSQFLDMCMDLKVHPEQEKLMTVRTITGNIYYARSGTKIIGKVHEKFTLIDGIRVATGSYSFT

SEQ ID NO: 2214 - protein, 174 aa, Homo sapiens [sequence omitted]

SEQ ID NO: 2215 - protein, 222 aa, Homo sapiens
MDNISLEYFEEAVCYMLQHPQVKGPGIGLLGISLGADICLSMASFLKNVSATVSINGSGISGNTAINYKHSSIPPLGYDLRRIKVAFSGLVDIVDIRNALVGGYKNPSMIPIEKAQGPILLIVGQDDHNWRSELYAQTVSERLQAHGKEKPQIICYPGTGHYIEPPYFPLCPASLHRLLNKHVIWGGEPRAHSKAQEDAWKQILAFFCKHLGGTQKTAVPKL

SEQ ID NO: 2216 - protein, 628 aa, Homo sapiens
MAHAPEPDPAACDLGDERPKWDNKAQYLLSCIGFAVGLGNIWRFPYLCQTYGGGAFLIPYVIALVFEGIPIFHVELAIGQRLRKGSVGVWTAISPYLSGVGLGCVTLSFLISLYYNTIVAWVLWYLLNSFQHPLPWSSCPPDLNRTGFVEECQGSSAVSYFWYRQTLNITADINDSGSIQWWLLICLAASWAVVYMCVIRGIETTGKVIYFTALFPYLVLTIFLIRGLTLPGATKGLIYLFTPNMHILQNPRVWLDAATQIFFSLSLAFGGHIAFASYNSPRNDCQKDAVVIALVNRMTSLYASIAVFSVLGFKATNDYEHCLDRNILSLINDFDFPEQSISRDDYPAVLMHLNATWPKRVAQLPLKACLLEDFLDKSASGPGLAFVVFTETDLHMPGAPVWAMLFFGMLFTLGLSTMFGTVEAVITPLLDVGVLPRWVPKEALTGLVCLVCFLSATCFTLQSGNYWLEIFDNFAASLNLLMLAFLEVVGVVYVYGMKRFCDDIAWMTGRRPSPYWRLTWRVVSPLLLTIFVAYIILLFWKPLRYKAWNPKYELFPSRQEKLYPGWARAACVLLSLLPVLWVPVAALAQLLTRRRRTWRDRDARPDTDMRPDTDTRPDTDMRPDTDMR

SEQ ID NO: 2217 - protein, 112 aa, Homo sapiens [sequence omitted]

SEQ ID NO: 2218 - protein, 117 aa, Homo sapiens [sequence omitted]

SEQ ID NO: 2219 - protein, 399 aa, Homo sapiens
MVSVLVQEGHAVSDMLLPLDGELVLASGAGFGVSDVGSHLDCGAGEPAVFRDSDRFSWHDPHLWRSGDEAPGLFFVDAERVPCRHDDVFFPPSASFRVGLGPGASPVRVRSISALGRTFTRDEDLAVFLASRAGRLRFHGPGALSVGPEDCADPSGCVCGNAEAQPWICAALLQPLGGRCPQAACHSALRPQGQCCDLCGAVVLLTHGPAFDLERYRARILDTFLGLPQYHGLQVAVSKVPRSSRLREADTEIQVVLVENGPETGGAGRLARALLADVAENGEALGVLEATMRESGAHVWGSSAAGLAGGVAAAVLLALLVLLVAPPLLRRAGRLRWRRHEAAAPAGAPLGFRNPVFDVTASEELPLPRRLSLVPKAAADSTSHSYFVNPLFAGAEAEA

SEQ ID NO: 2220 - protein, 722 aa, Homo sapiens [sequence omitted]

SEQ ID NO: 2221 - protein, 118 aa, Homo sapiens [sequence omitted]

SEQ ID NO: 2222 - protein, 138 aa, Homo sapiens [sequence omitted]

SEQ ID NO: 2223 - protein, 116 aa, Homo sapiens [sequence omitted]

SEQ ID NO: 2224 - protein, 470 aa, Homo sapiens
MDRGEKIQLKRVFGYWWGTSFLLINIIGAGIFVSPKGVLAYSCMNVGVSLCVWAGCAILAMTSTLCSAEISISFPCSGAQYYFLKRYFGSTVAFLNLWTSLFLGSGVVAGQALLLAEYSIQPFFPSCSVPKLPKKCLALAMLWIVGILTSRGVKEVTWLQIASSVLKVSILSFISLTGVVFLIRGKKENVERFQNAFDAELPDISHLIQAIFQGYFAYSGGACFTLIAGELKKPRTTIPKCIFTALPLMTVVYLLVNISYLTVLTPREILSSDAVAITWADRAFPSLAWIMPFAISTSLFSNLLISIFKSSRPIYLASQEGQLPLLFNTLNSHSSPFTAVLLLVTLGSLAIILTSLIDLINYIFFTGSLWSILLMIGILRRRYQEPNLSIPYKVFLSFPLATIVIDVGLVVIPLVKSPNVHYVYVLLLVLSGLLFYIPLIHFKIRLAWFEKMTCYLQLLFNICLPDVSEE

SEQ ID NO: 2225 - protein, 302 aa, Homo sapiens
MILLNNSHKLLALYKSLARSIPESLKVYGSVYHINHGNPFNMEVLVDSWPEYQMVIIRPQKQEMTDDMDSYTNVYRMFSKEPQKSEEVLKNCEIVNWKQRLQIQGLQESLGEGIRVATFSKSVKVEHSRALLLVTEDILKLNASSKSKLGSWAETGHPDDEFESETPNFKYAQLDVSYSGLVNDNWKRGKNERSLHYIKRCIEDLPAACMLGPEGVPVSWVTMDPSCEVGMAYSMEKYRRTGNMARVMVRYMKYLRQKNIPFYISVLEENEDSRRFVGQFGFFEASCEWHQWTCYPQNLVPF

SEQ ID NO: 2226 - protein, 372 aa, Homo sapiens [sequence omitted]

SEQ ID NO: 2227 - protein, 834 aa, Homo sapiens [sequence omitted]

SEQ ID NO: 2228 - protein, 111 aa, Homo sapiens [sequence omitted]

SEQ ID NO: 2229 - protein, 506 aa, Homo sapiens [sequence omitted]

SEQ ID NO: 2230 - protein, 162 aa, Homo sapiens
MLFGRIPLRYAILMQMRFDGRLGFPGGFVDTQDRSLEDGLNRELREELGEAAAAFRVERTDYRSSHVGSGPRVVAHFYAKRLTLEELLAVEAGATRAKDHGLEVLGLVRVPLYTLRDGVGGLPTFLENSFIGSAREQLLEALQDLGLLQSGSISGLKIPAHH

SEQ ID NO: 2231 - protein, 690 aa, Homo sapiens [sequence omitted]

SEQ ID NO: 2232 - protein, 218 aa, Homo sapiens
MEQGSGRLEDFPVNVFSVTPYTPSTADIQVSDDDKAGATLLFSGIFLGLVGITFTVMGWIKYQGVSHFEWTQLLGPVLLSVGVTFILIAVCKFKMLSCQLCKESEERVPDSEQTPGGPSFVFTGINQPITFHGATVVQYIPPPYGSPEPMGINTSYLQSVVSPCGLITSGGAAAAMSSPPQYYTIYPQDNSAFVVDEGCLSFTDGGNHRYGPILMLTS

SEQ ID NO: 2233 - protein, 167 aa, Homo sapiens [sequence omitted]

SEQ ID NO: 2234 - protein, 104 aa, Homo sapiens
MDVCGGRASQKRGQKTSREVKGPRHTPCPLQVALTALWCQHGIPEVTQPGRHETWRSVQMDPLLVVEQKNPNTINLSKDFLRMILECTSPHMCMHICQNIRVLF

SEQ ID NO: 2235 - protein, 420 aa, Homo sapiens [sequence omitted]

SEQ ID NO: 2236 - protein, 131 aa, Homo sapiens
MPLALLSSGCPHSWNSVLEWQNQFHLLVGVGWLPTHPQQASLGLKSQAVPSHVSKCFLAPMQQLHLAAFPEFPACSHSPSLWGPTMPQPVLSITSCFPLSSLLLLMHIYLKKKLPITILNGNSESLAIIRK

SEQ ID NO: 2237 - protein, 130 aa, Homo sapiens [sequence omitted]

SEQ ID NO: 2238 - protein, 107 aa, Homo sapiens
MQRLPAATRATLILSLAFASLHSACSAEASSSNSSTLTAHHPDPGTLEQCLNVDFCPQAARCCRTGVDEYGWIAAAVGWSLWFLTLILLCVDKLMKLTPDEPKDLQA

SEQ ID NO: 2239 - protein, 372 aa, Homo sapiens
MRGRSWHWAAWRGQAHRSTHTWQCPLGDLCPRHQLGGQLCRKWWESGQTWPWRLELPMLSDWLQGSFVWARKGPIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHALDTLFVPLLVGTGVALVTGATVLGTITCCFMKRLRKR

SEQ ID NO: 2240 - protein, 724 aa, Homo sapiens [sequence omitted]

SEQ ID NO: 2241 - protein, 141 aa, Homo sapiens
MLWALRERITEALSRDGYVYKYDLSLPVERLYDIVTDLRARLGPHAKHVVGYGHLGDGNLHLNVTAEAFSPSLLAALEPHVYEWTAGQQGSVSAEHGVGFRKRDVLGYSKPPGALQLMQQLKALLDPKGILNPYKTLPSQA

SEQ ID NO: 2242 - protein, 109 aa, Homo sapiens
MRSGVRNQPGQQGETPPISTKIISRAWWRIPVIPATLLGRLRQENCLNSGGGCCSEPISHHCTPAWATEQDSVSKKKINFKNYTLGTMYTPRVMGAPKSQKSLLRNLSM

SEQ ID NO: 2243 - protein, 411 aa, Homo sapiens [sequence omitted]

SEQ ID NO: 2244 - protein, 103 aa, Homo sapiens [sequence omitted]

SEQ ID NO: 2245 - protein, 624 aa, Homo sapiens
MADPEVCCFITKILCAHGGRMALDALLQEIALSEPQLCEVLQVAGPDRFVVLETGGEAGITRSVVATTRARVCRRKYCQRPCDNLHLCKLNLLGRCNYSQSERNLCKYSHEVLSEENFKVLKNHELSGLNKEELAVLLLQSDPFFMPEICKSYKGEGRQQICNQQPPCSRLHICDHFTRGNCRFPNCLRSHNLMDRKVLAIMREHGLNPDVVQNIQDICNSKHMQKNPPGPRAPSSHRRNMAYRARSKSRDRFFQGSQEFLASASASAERSCTPSPDQISHRASLEDAPVDDLTRKFTYLGSQDRARPPSGSSKATDLGGTSQAGTSQRFLENGSQEDLLHGNPGSTYLASNSTSAPNWKSLTSWTNDQGARRKTVFSPTLPAARSSLGSLQTPEAVTTRKGTGLLSSDYRIINGKSGTQDIQPGPLFNNNADGVATDITSTRSLNYKSTSSGHREISSPRIQDAGPASRDVQATGRIADDADPKVALVNGKYKGKTLWASTFVHDIPNGSSQVVDKTTDVEKTGATGFGLTMAVKAEKDMLCTGSQSLRNLVPTTPGESTAPAQVSTLPQSPAALSSSNRAAVWGAQGQNCTQVPVSSASELTRKTTGSAQCKSLKDKGASVS

SEQ ID NO: 2246 - protein, 602 aa, Homo sapiens [sequence omitted]

SEQ ID NO: 2247 - protein, 108 aa, Homo sapiens
MSHHAEIQRDILESCNHVRKKVPVTFVGAGGQDPEVPEELLHLLQPGQRVPQDVQHHLLEPRDRWAHLEVLKKVDLLLQVMAATGYFHASLQRGEIMRSPGPVARNSP

SEQ ID NO: 2248 - protein, 127 aa, Homo sapiens
MGEYLAEPMEGPCQNPVMCWGGELGWGWKWCSPAQPGFLLKVTVLEASTVPHPFLCPHLAHLPSISPQGTSVSPMGQVVGAMGGDEGVDLSSDLPLSTYEKSATTLTLCVFICKMHILVSSLVERIK

SEQ ID NO: 2249 - protein, 226 aa, Homo sapiens
MSRAQIWALVSGVGGFGALVAATTSNEWKVTTRASSVITATWVYQGLWMNCAGNALGSFHCRPHFTIFKVAGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 2250 - protein, 219 aa, Homo sapiens [sequence omitted]

SEQ ID NO: 2251 - protein, 438 aa, Homo sapiens
MQAEDRSQFGSAAEMLSEQTAALGTGWESMNVQLDGAEPQVERGSQEERPWRTVPGPLEHLCCDLEEEPQSLQEKAQSAPWVPAIPQEGNTGDWEMAAALLAAGSQGLVTIKDVSLCFSQEEWRSLDPSQTDFYGEYVMQENCGIVVSLRFPIPKLDMLSQLEGGEEQWVPDPQDLEERDILRVTYTGGGSEHEGDTPELEAEPPRMLSSVSEDTVLWNPEHDESWDSMPSSSRGMLLGPPFLQEDSFSNLLCSTEMDSLLRPHTCPQCGKQFVWGSHLARHQQTHTGERPYSCLKCEKTFGRRHHLIRHQKTHLHDKTSRCSECGKNFRCNSHLASHQRVHAEGKSCKGQEVGESPGTRKRQRAPPVPKCHVCTECGKSFGRRHHLVRHWLTHTGEKPFQCPRCEKSFGRKHHLDRHLLTHQGQSPRNSWDRGTSVF

SEQ ID NO: 2252 - protein, 134 aa, Homo sapiens [sequence omitted]

SEQ ID NO: 2253 - protein, 676 aa, Homo sapiens
MSSLQALCSGLPLRPLPENRGRQAGVPHAPVRTPSLSPVEKQLALRNALRYFPPDVQELLAPEFAQELQLYGHIYMYRFCPDIEMRAYPIEQYPCQTKVAAAIMHMIMNNLDPAVAQFPQELVTYGGNGQVFSNWAQFWLTMFYLSKMTEEQTLVMYSGHPLGLFPSSRSAPRLVITNGMVIPNYSSRTEYEKLFALGVTMYGQMTAGSYCYIGPQGIVHGTVLTVLNAARRYLGIEDLAGKVFVTSGLGGMSGAQAKAAVIVGCIGVIAEVDKAALEKRHRQGWLMEVTDSLDRCIQRLREARKKKEVLSLGYHGNVVALWERLVHELDTTGECLVDLGSDQTSCHNPFNGGYYPVQLSFTEAQSLMASNPAVFKDLVQESLRRQVSAINRLAEEKFFFWDYGNAFLLEAQRAGADVEKKGAGRTEFRYPSYVQHIMGDIFSQGFGPFRWVCTSGDPQDLAVTDELATSVLEEAIADGVKVSVKLQYMDNIRWIREAARHRLVVGSQARILYSDQKGRVAIAVAINQAIACRRIKAPVVLSRDHHDVSGTDSPFRETSNIYDGSAFCADMAVQNFVGDACRGATWVALHNGGGVGWGEVINGGFGLVLDGTPEAEGRARLMLSWDVSNGVARRCWSGNQKAYEIICQTMQENSTLVVTLPHKVEDERVLQQALQL

SEQ ID NO: 2254 - protein, 324 aa, Homo sapiens
MDGSRRVRATSVLPRYGPPCLFKGHLSTKSNAFCTDSSSLRLSTLQLVKNHMAVHYNKILSAKAAVDCSVPVSVSTSIKYADQQRREKLKKELAQCEKEFKLTKTAMRANYKNNSKSLFNTLQKPSGEPQIEDDMLKEEMNGFSSFARSLVPSSERLHLSLHKSSKVITNGPEKNSSSSPSSVDYAASGPRKLSSGALYGRRPRSTFPNSHRFQLVISKAPSGDLLDKHSELFSNKQLPFTPRTLKTEAKSFLSQYRYYTPAKRKKDFTDQRIEAETQTELSFKSELGTAETKNMTDSEMNIKQVISMKSFGIATFELQMFFSK

SEQ ID NO: 2255 - protein, 204 aa, Homo sapiens [sequence omitted]

SEQ ID NO: 2256 - protein, 349 aa, Homo sapiens
MRHPPLITVWRLEAKMDAGWTGLQASDIMWTISDTGWILNILCSLMEPWALGACTFVHLLPKFDPLVILKTLSSYPIKSMMGAPIVYRMLLQQDLSSYKFPHLQNCVTVGESLLPETLENWRAQTGLDIRESYGQTETGLTCMVSKTMKIKPGYMGTAASCYDVQIIDDKGNVLPPGTEGDIGIRVKPIRPIGIFSGYVDNPDKTAANIRGDFWLLGDRGIKDEDGYFQFMGRADDIINSSGYRIGPSEVENALMEHPAVVETAVISSPDPVRGEVVKAFVVLASQFLSHDPEQLTKELQQHVKSVTAPYKYPRKIEFVLNLPKTVTGKIQRAKLRDKEWKMSGKARAQ

SEQ ID NO: 2257 - protein, 109 aa, Homo sapiens [sequence omitted]

SEQ ID NO: 2258 - protein, 139 aa, Homo sapiens [sequence omitted]

SEQ ID NO: 2259 - protein, 234 aa, Homo sapiens
MKTGFSPTCTAAMTGGETVPLVCWVPEQGVPFIAFPILSRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGKAWRNPGSDCVL

SEQ ID NO: 2260 - protein, 154 aa, Homo sapiens [sequence omitted]

SEQ ID NO: 2261 - protein, 103 aa, Homo sapiens [sequence omitted]

SEQ ID NO: 2262 - protein, 702 aa, Homo sapiens [sequence omitted]

SEQ ID NO: 2263 - protein, 634 aa, Homo sapiens
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSMAAPWETGDTFPDVVAIAPDVRATSSPGLRDGSPDVTTADIGANTPDATKGCPDVQASLPDAKAKSPPTMVDSLLAVTLAGNLGLTFLRGSQTQSHPDLGTEGCWDQLSAPRTFTLLDPKASLLTMAFLNGALDGVILGDYLSRTPEPRPSLSHLLSQYYGAGVARDPGFRSNFRRQNGAALTSASILAQQVWGTLVLLQRLEPVHLQLQCMSQEQLAQVAANATKEFTEAFLGCPAIHPRCRWGAAPYRGRPKLLQLPLGFLYVHHTYVPAPPCTDFTRCAANMRSMQRYHQDTQGWGDIGYGFVVGSDGYVYEGRGWHWVGAHTLGHNSRGFGVAIVGNYTAALPTEAALRTVRDTLPSCAVRAGLLRPDYALLGHRQLVRTDCPGDALFDLLRTWPHFTAVSLRSLHYTARRPSVYTSSTRPLPPACNSCARTASARPPTSRRHVYSGNLGPAFAGHSAGNIPDPVTSAYAASAQPQTQPACPFPSS

SEQ ID NO: 2264 - protein, 234 aa, Homo sapiens
MEGHKAEEEVLDVLRLNVGGCIYTARRESLCRFKDSMLASMFSGRFPLKTDESGACVIDRDGRLFKYLLDYLHGEVQIPTDEQTRIALQEEADYFGIPYPYSLSDHLANEMETYSLRSNIELKKALTDFCDSYGLVCNKPTVWVLHYLNTSGASCESRIIGVYATKTDGTDAIEKQLGGRIHSKGIFKREAGNNVQYIWSYYSVAELKKMMDAFDAWEGKGTVQFFYFMEAGGL

SEQ ID NO: 2265 - protein, 326 aa, Homo sapiens [sequence omitted]

SEQ ID NO: 2266 - protein, 113 aa, Homo sapiens
MSGWRSPRKTPCVSDFRGCLEDFELLAPVFFCVFCLFKCTLNIVSCVFSFYLRFTIRNRIKLFKAGKLNYLYLPGNVLMSTLFHRLRHCSYTKMESYFHKLKQQKCPHLHFNM

SEQ ID NO: 2267 - protein, 141 aa, Homo sapiens [sequence omitted]

SEQ ID NO: 2268 - protein, 269 aa, Homo sapiens [sequence omitted]

SEQ ID NO: 2269 - protein, 573 aa, Homo sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAGQAYWFTPVIPALWEAEARGSLEVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 2270 - protein, 804 aa, Homo sapiens
MKKTPVFLESLVTNMLRLRAICPFSWRVFQFRPISCEPLIIQMNKCTDEEQMFGFIERNKAILSEKQVGCAFDMLWKLQKQKTSLLKNAEYVRDHPQFLTLHNLATNKFKLMNDDTLVNVLYVTQQFAGEAHDPLVEALVTEAWRRLERFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYKFLQFNSFEFIIMAKKKLTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHVYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLESIGGMDGTQQQIFKMLAEVLGGINCVKASVLTPYYHKVDFECILDKRKKPLPYGSHNIALGQLPEMPWESNIEIVGSRLPPGAERIALEFLDSKALCRNIPHMKGKSAMKKRHLEILGYRVIQISQFEWNSMALSTKDARMDYLRECIFGEVKSCL

SEQ ID NO: 2271 - protein, 181 aa, Homo sapiens
MGTASSLVSPAGGEVIEDTYGAGGGEACEIPVEVKPKARLLRNSFRRGAGAAAGAGPGSLPRGVGAGGLLGASFKSTGSSVPELEYAAAEYERLRKEYEIFRVSKNQELLSMGRREAKLDTENKRLRAELQVTPGWAATPGDPWEARPSCSLSKPSGFESSAETAHFNLRGHILFESEMIP

SEQ ID NO: 2272 - protein, 199 aa, Homo sapiens
MLWVNLLSGLFSLFFITIFLIREHSCVGDSWCLLFSPPSAFLDHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWLVKIAPQYYDMSNFPQCEAKRQLDRIIAKLQSKEYS

SEQ ID NO: 2273 - protein, 437 aa, Homo sapiens [sequence omitted]

SEQ ID NO: 2274 - protein, 181 aa, Homo sapiens
MQGQGALKESHIHLPTEQPEASLVLQGQLAESSALGPKGALRPQAQSPDVPVSWWQGSGKRLSHRLPHICSQPPLGPFLPLTWPSCGFFGLGGAASASLGLEVLQDSVSTWARGPCCPVHPQSLTVVCMCACMCVCVHVCACVYVCMCVLVCMCACACMRAHRYFLMDCAGICSPHGPGTQ

SEQ ID NO: 2275 - protein, 493 aa, Homo sapiens [sequence omitted]

SEQ ID NO: 2276 - protein, 741 aa, Homo sapiens [sequence omitted]

SEQ ID NO: 2277 - protein, 111 aa, Homo sapiens
MHTRLPLQVNSKAACKVPPFLQTLWVVSLGLNKWPNICMLTASSIPHASFVILWKEKNSAIFRETIYSYLNMEAFTRNSKYISFHLYNEKKDEKARLLLQLTLSALPFGFM

SEQ ID NO: 2278 - protein, 472 aa, Homo sapiens
MSPEEWTYLVVLLISIPIGFLFKKAGPGLKRWGAAAVGLGLTLFTCGPHTLHSLVTILGTWALIQAQPCPCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 2279 - protein, 555 aa, Homo sapiens
MEPVTKWSPKQVVDWTRGLDDCLQQYVHKFEREKINGEQLLQISHQDLEELGVTRIGHQELVLEAVDLLCALNYGLETDNMKNLVLKLRASSHNLQNYISSRRKSPAYDGNTSRKAPNEFLTSVVELIGAAKALLAWLDRAPFTGITDFSVTKNKIIQLCLDLTTTVQKDCFVAEMEDKVLTVVKVLNGICDKTIRSTTDPVMSQCACLEEVHLPNIKPGEGLGMYIKSTYDGLHVITGTTENSPADRSQKIHAGDEVTQVNQQTVVGWQLKNLVKKLRENPTGVVLLLKKRPTGSFNFTPAPLKNLRWKPPLVQTSPPPATTQSPESTMDTSLKKEKSAILDLYIPPPPAVPYSPRDENGSFVYGGSSKCKQPLPGPKGSESPNSFLDQESRRRRFTIADSDQLPGYSVETNILPTKMREKTPSYGKPRPLSMPADGNWMGIVDPFARPRGHGRKGEDALCRYFSNERIPPIIEESSSPPYRFSRPTTERHLVRGADYIRGSRCYINSDLHSSATIPFQEEGTKKKSGSSATKSSSTEPSLLVSWFTRLKLLTH

SEQ ID NO: 2280 - protein, 685 aa, Homo sapiens
MESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELEVAAINPNHPLAQMPLPPSMKNCIQLAACEATELLPMIPDLPADLFTSCLTTPIKIALRWFCMQKCVSLVPGVTLDLIEKIPGRLNDRRTPLGELNWIFTAITDTIAWNVLPRDLFQKLFRQDLLVASLFRNFLLAERIMRSYNCTPVSSPRLPPTYMHAMWQAWDLAVDICLSQLPTIIEEGTAFRHSPFFAEQLTAFQVWLTMGVENRNPPEQLPIVLQVLLSQVHRLRALDLLGRFLDLGPWAVSLALSVGIFPYVLKLLQSSARELRPLLVFIWAKILAVDSSCQADLVKDNGHKYFLSVLADPYMPAEHRTMTAFILAVIVNSYHTGQEACLQGNLIAICLEQLNDPHPLLRQWVAICLGRIWQNFDTARWCGVRDSAHEKLYSLLSDPIPEVRCAVVFALGTFVGNSAERTDHSTTIDHNVAMMLAQLVSDGSPMVRKELVVALSHLVVQYESNFCTVALQF

SEQ ID NO: 2281 - protein, 147 aa, Homo sapiens [sequence omitted]

SEQ ID NO: 2282 - protein, 214 aa, Homo sapiens
MTIAGHVRKEIPPSLCIGSLQVNDRRILDGMFAICGVSDSKFRTICSSVDKLDKVSWEEVKNEMVGEKGLAPEVADRIGDYVQQHGGVSLVEQLLQDPKLSQNKQALEGLGDLKLLFEYLTLFGIDDKISFDLSLARGLDYYTGVIYEAVLLQTPAQAGEEPLGVGSVAAGGRYDGLVGMFDPKGRKVPCVGLSIGVERIFSIVEQRLEVGPRR

SEQ ID NO: 2283 - protein, 107 aa, Homo sapiens
MAGCVTWAKPLDISRLGFHICHHQDTGLNVGYVVRQGRHRSPKGNKAFPHCPSIWTSLLPSIFKSHFETRFCHLPVLRIWESKGEGAIGSPACSRPRPGGSGRLIYF

SEQ ID NO: 2284 - protein, 455 aa, Homo sapiens
MYREEPTSIMNAIKLRPRQVLCDKCKNSVVAEKKEIRKGSSATDSSKYEDKKRRNESVTTVNKKLKTDHKVDGKNQNESQKRNAVVKVSNIAHSRGRVVKVSAQANTSKAQLSTKKVLQSKNMDHAKAREVLKIAKEKAQKKQNETSTSKNAHSKVHFTRRYQNPSSGSLPPRVRLKPQRYRNEENDSSLKTGLEKMRSGKMAPKPQSRCTSTRSAGEAPSENQSPSKGPEEASSEVQDTNEVHVPGDQDEPQTLGKKGSKNNISVYMTLNQKKSDSSSASVCSIDSTDDLKSSNSECSSSESFDFPPGSMHAPSTSSTSSSSKEEKKLSNSLKMKVFSKNVSKCVTPDGRTICVGDIVWAKIYGFPWWPARILTITVSRKDNGLLVRQEARISWFGSPTTSFLALSQLSPFLENFQSRFNKKRKGLYRKAITEAAKAAKQLTPEVRALLTQFET

SEQ ID NO: 2285 - protein, 462 aa, Homo sapiens
MVAVASESSIILWSVQDGGSGSEIGVFSLGVPVDALFFIGNQLVATSHTGKVGVWNAVTQHWQVQDVVPITSYDTAGSFLLLGCNNGSIYYIDMQKFPLRMKDNDLLVTELYHDPSNDAITALSVYLTPKTSVSGNWIEIAYGTSSGAVRVIVQHPETVGSGPQLFQTFTVHRSPVTKIMLSEKHLVSVCADNNHVRTWTVTRFRGMISTQPGPFGERDDQQVFIQKVVPITNKLFVRLSSTGKRICEIQAVDCTTISSFTVRECEGSSRMGSRPRRYLFTGHTNGSIQMWDLTTAMDMVNKSEDKDVGGPTEEELLKLLDQCDLSTSRCATPNISPATSVVQHSHLRESNSSLQLQHHDTTHEAATYSSMRPYRESPLLARARRTESFHSYRDFQTINLNRNVERAVPENGNLGPIQAEVKGATGECNISERKSPGVEIKSLRELDSGLEVHKIAEGFSES

SEQ ID NO: 2286 - protein, 570 aa, Homo sapiens
MALKKSSPSLDSGDSDSEELPTFAFLKKEPSSTKRRQPEREEKIVVVDISDCEASCPPAPELFSPPVPDIAETVTQTQPVRLLSSESEDEEEFIPLAQRLTCKFLTHKQLSPEDSSSPVKSVLDHQNNEGASCDWKKPFPKIPEVPLHDTPERSAADNKDLILDPCCQLPAYLSTCPGQSSSLAVTKTNSDILPPQKKTKPSQKVQGRGSHGCQQQRQARQKESTLRRQERKNAALVTRMKAQRPEECLKHIIVVLDPVLLQMEGGGQLLGALQTMECRCVIEAQAVPCSVTWRRRAGPSEDREDWVEEPTVLVLLRAEAFVSMIDNGKQGSLDSTMKGKETLQGFVTDITAKTAGKALSLVIVDQEKCFSAQNPPRRGKQGANKQTKKQQQRQPEASIGSMVSRVDAEEALVDLQLHTEAQAQIVQSWKELADFTCAFTKAVAEAPFKKLRDETTFSFCLESDWAGGVKVDLAGRGLALVWRRQIQQLNRVSLEMASAVVNAYPSPQLLVQAYQQCFSDKERQNLLADIQVRRGEGVTSTSRRIGPELSRRIYLQMTTLQPHLSLDSAD

SEQ ID NO: 2287 - protein, 141 aa, Homo sapiens
MSSMNPEYDYLFKLLLIGDSGVGKSCLLLRFAESFNNVKQWLQEIDRYASENVNKLLVGNKCDLTTKKVVDYTTAKEFADSLGIPFLETSAKNATNVEQSFMTMAAEIKKRMGPGATAGGAEKSNVKIQSTPVKQSGGGCC

SEQ ID NO: 2288 - protein, 152 aa, Homo sapiens [sequence omitted]

SEQ ID NO: 2289 - protein, 110 aa, Homo sapiens
MGTSLPKWWEVTVNYSLLNYHFQRFSVFNMGKRRNLRSNQGSAHQLFTETFNCVLFFVFFSIFQFLAVFAFSLRVPSSFFCFWSPFQLHVSMSSAVPHLLLKQIMSTFSY

SEQ ID NO: 2290 - protein, 672 aa, Homo sapiens [sequence omitted]

SEQ ID NO: 2291 - protein, 239 aa, Homo sapiens
MRSGVGLRGGHQGQPRRARRPRPARAQDLFPGRGGRGGALQNSPHGAGEPVQPWEEGADPAQLEVLLPAAEVPIGKPEGGRLIPGGAHHLLRRELAYERAVLPARTPPGLVGRPAQGLGLRAETLHLRQCARAGPGPRHTQRGQYGVVRGLVQRVVGGGLTQQLHGLPRQRLVCPQFPAHRLGPGALPAPQQQRGPQVPGPGPQHGRGGRGCQQQRAQRAGQPHPGTRAPLRGLTGAGH

SEQ ID NO: 2292 - protein, 253 aa, Homo sapiens
MRKQVRAKRAGRASAGQERSAFLPVAAVPETPRAPRRRRRRRLSNMAAPADVTGGCGRVGAGELGREAPEAAAGDPLPLQPTPFPALGACLFFGVPAPPDPRSCSPAPVTCPPSFRSPFPLHYPGLEPEPGGAPREWKSLGHAKVDPTQPPAVPSTPQTPPSSEATPRSCGRGPIWTPGSAGSAGRTLLSAAGRGGVRYLPGLPNPLEGASASKWFESGPLLFSRSKKIEQLTSFVCKTSFLASDLCYKVTRA

SEQ ID NO: 2293 - protein, 405 aa, Homo sapiens
MQECVEVSWSPLQGSCGPREACVLWEGTDSIKMENGQSTAAKLGLPPLTPEQQEAPQKAKKYAMEQSIKSVLVKQTIAHQQQQLTNLQMAAVTMGFGDPLSPLQSMAAQRQRALAIMCRVYVGSIYYELGEDTIRQAFAPFGPIKSIDMSWDPVTMKHKGFAFVEYEVPEAAQLALEQMNSVMLGGRNIKVGRPSNIGQAQPIIDQLAEEARAFNRIYVASVHQDLSDDDIKSVFEAFGKIKSCTLARDPTTGKHKGYGFIEYEKAQSSQDAVSSMNLFDLGGQYLRVGKAVTPPMPLLTPATPGGLPPAAAVAAAAATAKITAQEAVAGAAVLGTLGTPGLVSPALTLAQPLGTLPQAVMAAQAPGVITGVTPARPPIPVTIPSVGVVNPILASPPTLGLLEPK

SEQ ID NO: 2294 - protein, 140 aa, Homo sapiens [sequence omitted]

SEQ ID NO: 2295 - protein, 115 aa, Homo sapiens
MSAWQKRSRVMASLRLCSGHPSSSSSASTLGRERGVSDNWASFHHPTPTTCFGVSHSSCFPNLTPQPLPRALPTPPSVPTPSSQHWWSSPAGAWNGRPGTSCYSKRKSIGGRYLS

SEQ ID NO: 2296 - protein, 412 aa, Homo sapiens
MGVWTGRLGGWAQVMFQFLSQGFYCGVGLFTRFLKLLGALLLLALALFLGFLQLGWRFLVGLGDRLGWRDKATWLFSWLDSPALQRCLTLLRDSRPWQRLVRIVQWGWLELPWVKQNINRQGNAPVASGRYCQPEEEVARLLTMAGVPEDELNPFHVLGVEATASDVELKKAYRQLAVMVHPDKNHHPRAEEAFKVLRAAWDIVSNAEKRKEYEMKRMAENELSRSVNEFLSKLQDDLKEAMNTMMCSRCQGKHRRFEMDREPKSARYCAECNRLHPAEEGDFWAESSMLGLKITYFALMDGKVYDITEWAGCQRVGISPDTHRVPYHISFGSRIPGTRGRQRATPDAPPADLQDFLSRIFQVPPGQMPNGNFFAAPQPAPGAAAASKPNSTVPKGEAKPKRRKKVRRPFQR

SEQ ID NO: 2297 - protein, 365 aa, Homo sapiens
MREKSFQCNETGEAFNCSSFVRKHQIIHLGEKQYKFDICGKVFNEKRYLARHRRCHTSEKPYKCNECGKSFSYKSSLTCHRRCHTGEKPYKCNECGKSFSYKSSLTCHHRCHTGEKPYKCNECGKSFSYKSSLRCHRRLHTGIKPYKCNECGKMFGQNSTLVIHKAIHTGEKPYKCNECGKAFNQQSHLSRHHRLHTGEKPYKCNDCVKAFIHQSSLARHHRLHTGEKSYKCEECDRVFSQKSNLERHKIIHTGEKPYKCNECHKTFSHRSSLPCHRRLHSGEKPYKCNECGKTFNVQSHLSRHHRLHTGEKPYKCKVCDKAFMCHSYLANHTRIHSGEKPYKCNECGKAHNHLIDSSIKPCMSS

SEQ ID NO: 2298 - protein, 114 aa, Homo sapiens
MSEELALGQTEEPGPQGLFSEEAQERLRKRGNNPPAGEEGETSHWQVQVQPLPEAAGWGRTSRSFPVDHLPGHIAPQKRLWEGLSGSWQLCPLALTWPLRVFLGPSLCPWPSSS

SEQ ID NO: 2299 - protein, 671 aa, Homo sapiens
MGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKMCDIGDASRGSLSSYAYTLMVLYFLQQRNPPVIPVLQEIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPE

SEQ ID NO: 2300 - protein, 352 aa, Homo sapiens
MRKKLGPLSPTSFNPIISSQTSDSEEHPSSENIPPGYEVVSLLEALNGPLTPSPAVPPLHVLGDGHLSGMLPSYGSDGHLPPVRTISPLDRLSDSSSQGLKLKKSLSKSTSQNSSVLHEEEDEHSCSESETQLSQRPSVQHLGEECGVTPESENLTLSSSGAIDQSSCTGTPLSSTISSPEGPASSSLAQSVMSMASSQISTDTVSSMSGSYIAPGTEEEGEALSSPQPASRAPSEEGEGLPAESPDSNFAGLPAGEQDAEGNDVIEEEDGSPTQEGQRTCAFLGMECDNNNDFDIASVKALDNKLCSEVCLPGAWQADDNAVSRNAQRRRLSSSSLEDSETRPCVWGPLAV

SEQ ID NO: 2301 - protein, 103 aa, Homo sapiens [sequence omitted]

SEQ ID NO: 2302 - protein, 380 aa, Homo sapiens
MAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQGGNYYCLEMAQQLYSA

SEQ ID NO: 2303 - protein, 259 aa, Homo sapiens [sequence omitted]

SEQ ID NO: 2304 - protein, 207 aa, Homo sapiens
MYLVTVLGNLLIILAIGSDSHLDTPMYFFLSNLSLPDIGFTSATVPKMIEEMQSHSRVIYHGDCLTQMSFFVLFACKDDMILTVMAYDWFVAICHPLNYPGIMNPHLCVLLVLVPFFLSLLDSQLHNLIVLQFICFKNVEISNFFCDPFQRLNLACSDSDINNIYIYLDSTIFGFLRISGILLCYYTVVFPILRIPSSDGNYKAFST

SEQ ID NO: 2305 - protein, 147 aa, Homo sapiens
MTEGLFISCSAVRVKPNRRAGLRRRSPAFLLSANQKTRLFALGSSPRCGPRANGEEASSCAWVSRAPRAACARAKPASRAPEGPVSRKTRGGEAALASARPATDCLRSGLAVERRRKPNSRPAPGVGSLPGSRPQDPQGAAGRRLSP

SEQ ID NO: 2306 - protein, 137 aa, Homo sapiens [sequence omitted]

SEQ ID NO: 2307 - protein, 645 aa, Homo sapiens
MTKQDSASKKKKKRYLRASSNRNFLLTMRPFLKRAILVLSYVLVILYFRLWIMGGSMPLFSEQDNPASFSPYILTRFLTYSYLLAFNVWLLLAPVTLCYDWQVGSIPLVETIWDMRNLATIFLAVVMALLSLHCLAAFKRLEHKEVLVGLLFLVFPFIPASNLFFRVGFVVAERVLYMPSMGYCILFVHGLSKLCTWLNRCGATTLIVSTVLLLLLFSWKTVKQNEIWLSRESLFRSGVQTLPHNAKVHYNYANFLKDQGRNKEAIYHYRTALKLYPRHASALNNLGTLTRDTAEAKMYYQRALQLHPQHNRALFNLGNLLKSQEKKEEAITLLKDSIKYGPEFADAYSSLASLLAEQERFKEAEEIYQTGIKNCPDSSDLHNNYGVFLVDTGLPEKAVAHYQQAIKLSPSHHVAMVNLGRLYRSLGENSMAEEWYKRALQVAHKAEILSPLGALYYNTGRYEEALQIYQEAAALQPSQRELRLALAQVLAVMGQTKEAEKMTNHIVSEETGCLECYRLLSAIYSKQENHDKALDAIDKALQLKPKDPKVISELFFTKGNQLREQNLLDKAFESYRVAVQLNPDQAQAWMNMGGIQHIKGKYVSARAYYERALQLVPDSKLLKENLAKLDRLEKRLQEVREKDQT

SEQ ID NO: 2308 - protein, 184 aa, Homo sapiens
MALDAGSAACLPQRRGSATPVRLHAPPLIQCHGDLIGTREPLAGGLAGLLSVSTPKHRCPPPCAFCWPLRAFRDCLRLGHSLDLRGATLFPRGSARGLFPCPSSGISGQPPFRRLSRPSPAPELQSFHDFGPLRTWCALRCQRPGPTVLGSSLVFCLAAGGLFCIPCCPSCKTLSCFTHPEPFL

SEQ ID NO: 2309 - protein, 588 aa, Homo sapiens
MQKIKSLMTRQGLKSPQESLSDLGAIESLRVPGKEEFRELREQPSDPQAEQELINSIEQVYFSVDSFDIVKYELEKLPPVLNLQELEAYRDKLKQQQAAVSKKVADLILEKQPAYVKELERVTSLQTGLQLAAVICTNGRRHLNIAKEGFTQASLGLLANQRKRQLLIGLLKSLRTIKTLQRTDVRLSEMLEEEDYPGAIQLCLECQKAASTFKHYSCISELNSKLQDTLEQIEEQLDVALSKICKNFDINHYTKVQQAYRLLGKIQTAMDQLHMHFTQAIHNTVFQVVLGYVELCAGNTDTKFQKLQYKDLCTHVTPDSYIPCLADLCKALWEVMLSYYRTMEWHEKHDNEDTASASEGSNMIGTEETNFDRGYIKKKLEHGLTRIWQDVQLKVKTYLLGTDLSIFKYDDFVFVLDIISRLMQVGEEFCGSKSEVLQESIRKQSVNYFKNYHRTRLDELRMFLENETWELCPVKSNFSILQLHEFKFMEQSRSPSVSPSKQPVSTSSKTVTLFEQYCSGGNPFEIQANHKDEETEDVLASNGYESDEQEKSAYQEYDSDSDVPEELKRDYVDEQTGDGPVKSVSRET

SEQ ID NO: 2310 - protein, 110 aa, Homo sapiens [sequence omitted]

SEQ ID NO: 2311 - protein, 545 aa, Homo sapiens
MWLDRRGWLRVLGHWRYDLRRPSFTRTWSGDKGPMAETVSTQVGTEGGLRASHQQNGDAGGDAKVELSPGPPKPAGREVEPAPVGGEHPSAAAPGPGKHKKRRGATRERVVPPPKKRRTGVSFGDEHFAETSYYFEGGLRKVRPYYFDFRTYCKGRWVGHSLLHVFSTEFRAQPLAYYEAAVRAGRLQLNEKPVQDLNIVLKDNDFLRNTVHRHEPPVTAEPIRLLAENEDVVVVDKPSSIPVHPCGRFRHNTVIFILGKEHQLKELHPLHRLDRLTSGVLMFAKTAAVSERIHEQVRDRQLEKEYVCRVEGEFPTEEVTCKEPILVVSYKVGVCRVDPRGKPCETVFQRLSYNGQSSVVRCRPLTGRTHQIRVHLQFLGHPILNDPIYNSVAWGPSRGRGGYIPKTNEELLRDLVAEHQAKQSLDVLDLCEGDLSPGLTDSTAPSSELGKDDLEELAAAAQKMEEVAEAAPQELDTIALASEKAVETDVMNQETDPLCAECRLVRQDPLPQDLVMFLHALRYKGPGFEYFSPMPAWAQDDWQKD

SEQ ID NO: 2312 - protein, 665 aa, Homo sapiens [sequence omitted]

SEQ ID NO: 2313 - protein, 242 aa, Homo sapiens
MGELSPAVAQEETPPGDWLFGGVRWGWNFRCKPPVGLNPRTGPEGLPYSSPDNGEAILDPSQAPRPFNEPCKYPGRTKGFGHKPGLKKHPAAPPGGRPFTCATCGKSFQLQVSLSAHQRSCGAPDGSGPGTGGGGSGSGGGGGGSGGGSARDGSALRCGECGRCFTRPAHLIRHRMLHTGERPFPCTECEKRFTERSKLIDHYRTHTGVRPFTCTVCGKSFIRKDHLRKHQRNHAAGAKTPA

SEQ ID NO: 2314 - protein, 482 aa, Homo sapiens
MDSFGQPRPEDNQSVVRRMQKKYWKTKQVFIKATGKKEDEHLVASDAELDAKLEVFHSVQETCTELLKIIEKYQLRLNVISEEENELGLFLKFQAERDATQAGKMMDATGKALCSSAKQRLALCTPLSRLKQEVATFSQRAVSDTLMTINRMEQARTEYRGALLWMKDVSQELDPDTLKQMEKFRKVQMQVRNSKASFDKLKMDVCQKVDLLGASRCNMLSHSLTTYQRTLLGFWKKTARMVSQIHEACIGFHPYDFVALKQLQDTPSKISEDNKDEQIGGFLTEQLNKLVLSDEEASFESEQANKDHNEKHSQMREFGAPQFSNSENVAKDLPVDSLEGEDFEKEFSFLNNLLSSGSSSTSEFTQECQTAFGSPSASLTSQEPSMGSEPLAHSSRFLPSQLFDLGFHVAGAFNNWVSQEESELCLSHTDNQPVPSQSPKKLTRSPNNGNQDMSAWFNLFADLDPLSNPDAIGHSDDELLNA

SEQ ID NO: 2315 - protein, 710 aa, Homo sapiens
MSSQQFPRLGAPSTGLSQAPSQIANSGSAGLINPAATVNDESGRDSEVSAREHMSSSSSLQSREEKQEPVVVRPYPQVQMLSTHHAVASATPVAVTAPPAHLTPAVPLSFSEGLMKPPPKPTMPSRPIAPAPPSTLSLPPKVPGQVTVTMESSIPQASAIPVATISGQQGHPSNLHHIMTTNVQMSIIRSNAPGPPLHIGASHLPRGAAAAAVMSSSKVTTVLRPTSQLPNAATAQPAVQHIIHQPIQSRPPVTTSNAIPPAVVATVSATRAQSPVITTTAAHATDSALRPTLSIQHPPSAAISIQRPAQSRDVTTRITLPSHPALGTPKQQLHTMAQKTIFSTGTPVAAATVAPILATNTIPSATTAGSVSHTQAPTSTIVTMTVPSHSSHATAVTTSNIPVAKVVPQQITHTSPRIQPDYPAERSSLIPISGHRASPNPVAMETRSDNRPSVPVQFQYFLPTYPPSAYPLAAHTYTPITSSVSTIRQYPVSAQAPNSAITAQTGVGVASTVHLNPMQLMTVDASHARHIQGIQPAPISTQGIQPAPIGTPGIQPAPLGTQGIHSATPINTQGLQPAPMGTQQPQPEGKTSAVVLADGATIVANPISNPFSAAPAATTVVQTHSQSASTNAPAQGSSPRPSILRKKPATDGMAVRKTLIPPQPPDVASPRVESSMRSTSGSPRPAGAKPKSEIHVSMATPVTVSMETVS

SEQ ID NO: 2316 - protein, 119 aa, Homo sapiens
MLCRDTHCIPPFSPSNYPNFLGSLLRTGHECSLLKYWATLATCNKVHVKMADEAVCVGPAPTSKSYLNMDAIMEAIKKTRAQAVHPGYGFLSENKEFARCLASFIMSIKGPSMGDYEDC

SEQ ID NO: 2317 - protein, 770 aa, Homo sapiens
MDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIERGDIVIGRISSIREFGFFMVLICLGSGIMRDIAHLEITALCPLRDVPSHSNHGDPLSYYQTGDIIRAGIKDIDRYHEKLAVSLYSSSLPPHLSGIKLGVISSEELPLYYRRSVELNSNSLESYENVMQSSLGFVNPGVVEFLLEKLGIDESNPPSLMRGLQSKNFSEDDFASALRKKQSASWALKCVKIGVDYFKVGRHVDAMNEYNKALEIDKQNVEALVARGALYATKGSLNKAIEDFELALENCPTHRNARKYLCQTLVERGGQLEEEEKFLNAESYYKKALALDETFKDAEDALQKLHKYMQKSLELREKQAEKEEKQKTKKIETSAEKLRKLLKEEKRLKKKRRKSTSSSSVSSADESVSSSSSSSSSGHKRHKKHKRNRSESSRSSRRHSSRASSNQIDQNRKDECYPVPANTSASFLNHKQEVEKLLGKQDRLQYEKTQIKEKDRCPLSSSSLEIPDDFGGRSEDPRDFYNSYKTQAGSSKTEKPYKSERHFSSRRNSSDSFCRNSEDKIYGYRRFEKDIEGRKEHYRRWEPGSVRHSTSPASSEYSWKSVEKYKKYAHSGSRDFSRHEQRYRLNTNQGEYEREDNYGEDIKTEVPEEDALSSKEHSESSVKKNLPQNLLNIFNQIAEFEKEKGNKSKN

SEQ ID NO: 2318 - protein, 125 aa, Homo sapiens
MEGQGTQGRPTVPLSPTCTLACSCQPPRQPSPLLSSTCIVSALHTRQRGTHPLGNGSFPPVPAGSHAVCSAGAAEHIHRCCPALPICTLLSCSWICLFMLGFTRVTMIVKRKKKKKKDACILKCL

SEQ ID NO: 2319 - protein, 273 aa, Homo sapiens
MEDEGLWDMFVKDIPRSATSYTLSLDKLRQGVTYEFRVVAVNEAGYGEPSNPSTAVSAQVEAPFYEEWWFLLVMALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRRAQGRAPAPHRYEAVAGSEAGAQLHPVITTQSAGGVYTPAGPGARTPLTGFSSFV

SEQ ID NO: 2320 - protein, 159 aa, Homo sapiens [sequence omitted]

SEQ ID NO: 2321 - protein, 257 aa, Homo sapiens
MLPRGRGRCWWCGPGPGAWQYAPGWRWDLSRAWLALRRFFFLRTGPEPPGPDSFRGAVVCGDLPAAPLEHLAALFSEVVLPVLANEKNRLNWPHMICEDVRRHAHSLQCDLSVILEQVKGKTLLPLPAGSEKMEFADSKSETVLDSIDKSVIYAIESAVIKWSYQVQVVLKRESSQPLLQGENPTPKVELEFWKSRYEDLKYIYNQLRTITVRGMAKLLDKLQSSYFPAFKAMYRDVVAGEDQQVFSQMCLTQVTVE

SEQ ID NO: 2322 - protein, 101 aa, Homo sapiens
MWWMLAREVLRMRGTISREHPWEVMPDLYFYRDPEEIEKEEQAAAEKAVTKEEFQGEWTAPAPEFTATQPEVADWSEGVQVPSVPIRQFPTGMYQDRGESS

SEQ ID NO: 2323 - protein, 343 aa, Homo sapiens
MGSPGASLGIKKALQSEQATALPASAPAVSQPTAPAPSCLPKAGQVIPALLREAPFSSVIAPTLLCGFLFLAWVAAEVPEESSRMAGSGARSEEGRRQHAFVPEPFDGANVVPNLWLHSFEVINDLNHWDHITKLRFLKESLRGEALGVYNRLSPQDQGDYGTVKEALLKAFGVPGAAPSHLPKEIVFANSMGKGYYLKGKIGKVPVRFLVDSGAQVSVVHPNLWEEVTDGDLDTLQPFENVVKVANGAEMKILGVWDTAVSLGKLKLKAQFLVANASAEEAIIGTDVLQDHNAILDFEHRTCTLKGKKFRLLPVGGSLEDEFDLELIEEDPSSEEGRQELSH

SEQ ID NO: 2324 - protein, 235 aa, Homo sapiens
MITGSPQMTWCPPFWTPPISTASRYGSHGAFYRYKNSMGKSLPLFYIYDSYLTSPEAWAHLLTPNGPHSIRNTPYDGVFIALLVEEGHTHDILAAGFDGMYTYFASNGFSFGSSHQNWKAVKNFCDANNLMFIPSVGPGYIDTSIRPWNNHNTRNRVNGKYYETALQAALTVRPEIVSITSFNEWHEGTQIEKAIPKKTPTRLYLDYLPHQPSLYLELTRRWAEHFIKEKEQWLM

SEQ ID NO: 2325 - protein, 524 aa, Homo sapiens
MAQQNMKVRPVLLKRNSLESVEFVKQPHHRRSKSQQVRFKEDGTTKNPTGLAEVDVQTPEDPAVMGKTQATRHHLPPTYSLSFPRSQKAGGFRNIAIQTSPSLRKHFPVFKRKRLTASKSLVEMPTASQSAIQVNGNLSEQDIVSSDLAYLRLAQHLEDGPRRVKVSHAFLPRVPKVQSNGPVSICLEAGTWRSLEKATAAIQVPDDIYHSPSWEARESALSPDRSAEVRNSIHPLDDTRPGDGRRVTPLDSEKSTSCLNATSVASHTPGTEELKPELLLPKDNSDDKDLGSLSSQSKETCVPSSPRTHSSPSQGSHSQPAHPGRASDCPSSSNNHQNLVSLKTNSASKSAPGCQEQTANNPTESDTLEFPNCPGSNHLPSSLSRSETKLQSNREISDINQIHLARGELCDLQGRLQSVEESLHSNQEKIKVLLNVIQDLEKARALTEGRNFYRTGQDLNNCSTCQNTACIIYSVEYDFRQQEGRFHEVLQSLEEAEPVEEASPPPKSPAEPPAPEKQDLRRKT

SEQ ID NO: 2326 - protein, 378 aa, Homo sapiens
MEVAELGFPETAVSQSRICLCAVLCGHWDFADMMVIRSLSLIRLEGVEGRDPVGGGNLTNKRPSCAPSPQDLSAQWKQLEDRGASSRRVDMAALFQEASSCPVCSDYLEKPMSLECGCAVCLKCINSLQKEPHGEDLLCCCSSMVSRKNKIRRNRQLERLASHIKELEPKLKKILQMNPRMRKFQVDMTLDANTANNFLLISDDLRSVRSGRIRQNRQDLAERFDVSVCILGSPRFTCGRHCWEVDVGTSTEWDLGVCRESVHRKGRIQLTTELGFWTVSLRDGGRLSATTVPLTFLFVDRKLQRVGIFLDMGMQNVSFFDAESGSHVYTFRSVSAEEPLRPFLAPSVPPNGDQGVLSICPLMNSGTTDAPVRPGEAK

SEQ ID NO: 2327 - protein, 137 aa, Homo sapiens
MEYIQQLKDFTTDDLLQLLMSCPQVELIQCLTKELNEKQPSLSFGLAILHLFSVDMKKVGIKLLQEINKGGIDAVESLMINDSFCSIEKWQEVANICSQNGFDKLSNDITSILRSQAAVTEISEEDDAVNLMEHVFW

SEQ ID NO: 2328 - protein, 222 aa, Homo sapiens
MNKSESDQEDNDDINDNDWSYGSEKKAKKRKSDKNPNSPRRSKSLKHKNGELSNSDPFKYNNSTGISYETLGPEELRSLLTTQCGVISEHTKKMCTRSLRCPQHTDEQRRTVRIYFLGPSAVLPEVESSLDNDSFDMTDSQALISRLQWDGSSDLSPSDSGSSKTSENQGWGLGTNSSESRKTKKKKSHLSLVGTASGLGSNKKKKPKPPAPPTPSIYDDIN

SEQ ID NO: 2329 - protein, 194 aa, Homo sapiens
MEDGLLEIMTKDGGDMPAPLEVSTVPAVGDVISGEYNGGMKELMEHLKAQLQALFEDVRAMRGALDEQASHIQVLSDGVCANQRAIVSMCQIMTTAPRQGGLGVVGGKGSFQSDPQEPETPSPGIGDSGLLGRDPEDEEEEEEEKEMPSPATPSSHCERPESPCAGLLGGDGPLVEPLDMPDITLLQLEGEASL

SEQ ID NO: 2330 - protein, 118 aa, Homo sapiens [sequence omitted]

SEQ ID NO: 2331 - protein, 555 aa, Homo sapiens [sequence omitted]

SEQ ID NO: 2332 - protein, 205 aa, Homo sapiens
MMPRHLLPHSGITSLRRVPRRRLPSRRREDFRRFLFLSFVSTDKDGDPTGQASPAVPVPHFTTWGSLIPIDSQRNKERTRFTWMDGPPHGGLGTRFSGRGSASLTAPPGRCFTRERHPVPRQRKCRRQHSTGRKPHCGTRSAAPRNPKSIHKRSFSAKSLKNKTRNESPPVSALVSRTKTQPGQLHFCCQPSSSQAPASRRAKGR

SEQ ID NO: 2333 - protein, 319 aa, Homo sapiens
MDWKLEGSTQKVESPVLQGQEGILEETGEDGLPEGFQLLQIDAEGECQEGEILATGSTAWCSKNVQRKQRHWEKIVAAKKSKRKQEKERRKANRAENPGICPQHSKRFLRALTKDKLLEAKHSGPRLCIDLSMTHYMSKKELSRLAGQIRRLYGSNKKADRPFWICLTGFTTDSPLYEECVRMNDGFSSYLLDITEEDCFSLFPLETLVYLTPDSEHALEDVDLNKVYILGGLVDESIQKKVTFQKAREYSVKTARLPIQEYMVRNQNGKNYHSEILAINQVFDILSTYLETHNWPEALKKGVSSGKGYILRNSVELWA

SEQ ID NO: 2334 - protein, 136 aa, Homo sapiens
MNCDALLHHSAIPEDFLHIFLLLQKISVSLPLSLSQSVCLFYSISLCVSLLLHISLCVSVYVSLSLSSFPCFSLTHTHTHSQLSKDTSVLTFTFCFKQHTHFTLNYTSHAHELSAPSVHPTCVFTFKAAPSPRPAT

SEQ ID NO: 2335 - protein, 110 aa, Homo sapiens
MQKAGRHHPLRAPPASSQYWIGLAWLVAVWEKQPKRLVYFNTKLDHGPFPTGLFKGLYGIHCLVSFFAVHHSKECHLHPKPPFSHEGKSKKGLQFLLKGVPFVGRVINTI

SEQ ID NO: 2336 - protein, 434 aa, Homo sapiens
MIMEDWTCKLQNRVLPSEDPALSQKGYLKKENMAALCRTAESQAELQCTQLDLERKLKLNENAISRLQANQKSVLVSVSEVKAVAEMQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAWYSDMETPLKAGPFRRLGVYIDFPGGILSFYGVEYDTMTLVHKFACKFSEPVYAAFWLSKKENAIRIVDLGEEPEKPAPSLVGTAP

SEQ ID NO: 2337 - protein, 136 aa, Homo sapiens [sequence omitted]

SEQ ID NO: 2338 - protein, 178 aa, Homo sapiens
MHMMVSKPEQWVKPMAVAGANQYTFHLEATENPGALIKDIRENGMKSCSVTQAEVQWHSQGPLQVGLAIKPGTSVEYLAPWANQIDMALVMTVEPGFGGQKFMEDMMPKVHWLRTQFPSLDIEVDGGVGPDTVHKCAEAGANMIVSGSAIMRSEDPRSVINLLRNVCSEAAQKRSLDR

SEQ ID NO: 2339 - protein, 265 aa, Homo sapiens [sequence omitted]

SEQ ID NO: 2340 - protein, 154 aa, Homo sapiens [sequence omitted]

SEQ ID NO: 2341 - protein, 168 aa, Homo sapiens
MVLFFRINLQTKKCKQKGKGEQRENRPKWLTKKLKKTYLRKTGKRRLRRVQPLMKQERKKPSLINNHIPCLISGPCLPSCAIQRNIFINYFVNASFLVAPETFLRRRESHLIPFFKCKCFFLRGEIICWLFIFWYNQKIVWDIELWEALTVSGVSLTFHRWGVSFYIL

SEQ ID NO: 2342 - protein, 799 aa, Homo sapiens
MSLQSAQYLRQAEVLKADMTDSKLGPAEVWTSRQALQDLYQKMLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHVTVINLFQLHHLRDFSNETEQHTYSQDEQLCWTQLLALFMSFLGILCKCPLQNESQEESYNAYPLPAVKVSMDWLRLRPRVFQEAVVDERQYIWPWLISLLNSFHPHEEDLSSISATPLPEEFELQGFLALRPSFRNLDFSKGHQGITGDKEGQQRRIRQQRLISIGKWIADNQPRLIQCENEVGKLLFITEIPELILEDPSEAKENLILQETSVIESLAADGSPGLKSVLSTSRNLSNNCDTGEKPVVTFKENIKTREVNRDQGRSFPPKEVKSQTELRKTPVSEARKTPVTQTPTQASNSQFIPIHHPGAFPPLPSRPGFPPPTYVIPPPVAFSMGSGYTFPAGVSVPGTFLQPTAHSPAGNQVQAGKQSHIPYSQQRPSGPGPMNQGPQQSQPPSQQPLTSLPAQPTAQSTSQLQVQALTQQQQSPTKAVPALGKSPPHHSGFQQYQQADASKQLWNPPQVQGPLGKIMPVKQPYYLQTQDPIKLFEPSLQPPVMQQQPL

SEQ ID NO: 2343 - protein, 132 aa, Homo sapiens
MGESLEPGRRRLQCAETTSLNSSLGDRVRLCLKKKKSCGHKTWFRCRQRHALPRVLPSLWPLHTLPSLSFPPDLSESDSSFCPKQNPTFSRKVLAFVGPTLGHWYLLPVAVAFPLPEGRAVSAPSWSTADLF

SEQ ID NO: 2344 - protein, 397 aa, Homo sapiens
MVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 2345 - protein, 456 aa, Homo sapiens
MLQEAQVFRGLASTVSLSAESGKSEKGQPQDSKKQSPPKNVVEPKERGKLLATQTAAELSKNLSSPSSYPPAVNKGRKVASPSPSGSVLFTDEGVPKFLSRKTLVEFPQKVLSPFRKQGSDSEARQVGRKVTSPSSSSSSSSSDSESDDEADVSEVTPRVVSKGRGGLRKPEASHSFENRAPRVTVSAKEKTLLQKPHVDITDPEKPHQPKKKGSPAKPSEGRENARPKTTMPRSQVDEEFLKQSLKEKQLQKTFRLNEIDKESQKPFEVKGPLPVHTKSGLSAPPKGSPAPAVLAEEARAEGQLQASPPGAAEGHLEKPVPEPQRKAAPPLPRKETSGTQGIEGHLKGGQAIVEDQIPPSNLETVPVENNHGFHEKTAALKLEAEGEAMEDAAAPGNDRGGTQEPAPVPAEPFDNTTYKNLQHHDYSTYTFLDLNLELSKFRMPQPSSGRESPRH

SEQ ID NO: 2346 - protein, 127 aa, Homo sapiens [sequence omitted]

SEQ ID NO: 2347 - protein, 189 aa, Homo sapiens
MKEKLNGDTEEGFNRLSDEFSKSHKSRRKDLPNGDIDEYEKKSKRVSSLDTSTHKSSDNKLEETLTREQKEGAFSNFPISEETIKLLKGRGVTYLFPIQVKTFGPVYEGKDLIAQARTGTGKTFSFAIPLIERLQRNQETIKKSRSPKVLVLAPTRELANQVAKDFKDITRSPCSINASISSITSYTCF

SEQ ID NO: 2348 - protein, 172 aa, Homo sapiens
MKIWSSEHVFGHPWDTVIQAAMRKYPNPMNPSVLGVDVLQRRVDGRGRLHSLRLLSTEWGLPSLVRAILGTSRTLTYIREHSVVDPVEKKMELCSTNITLTNLVSVNERLVYTPHPENPEMTVLTQEAIITVKGISLGSYLESLMANTISSNAKKGWAAIEWIIEHSESAVS

SEQ ID NO: 2349 - protein, 495 aa, Homo sapiens
MVSPPLLIISVAGTIECKPDHLLWRPGSTSPQSVSFLHGKVVMESLGRPIPPTSSPSLLPSAQLPSSHNPPPVSCQMPLLDSNTSHQIMDTNPDEEFSPNSYLLRACSGPQQASSSGPPNHHSQSTLRPPLPPPHNHTLSHHHSSANSLNRNSLTNRRSQIHAPAPAPNDLATTPESVQLQDSWVLNSNVPLETRHFLFKTSSGSTPLFSSSSPGYPLTSGTVYTPPPRLLPRNTFSRKAFKLKKPSKYCSWKCAALSAIAAALLLAILLAYFIAMHLLGLNWQLQPADGHTFNNGIRTGLPGNDDVATMPSGGKVPWSLKNSSIDSGEAEVGRRVTQEVPPGVFWRSQIHISQPQFLKFNISLGKDALFGVYIRRGLPPSHAQYDFMERLDGKEKWSVVESPRERRSIQTLVQNEAVFVQYLDVGLWHLAFYNDGKDKEMVSFNTVVLDSVQDCPRNCHGNGECVSGVCHCFPGFLGADCAKAACPVLCSGNGQ

SEQ ID NO: 2350 - protein, 412 aa, Homo sapiens
MHADNPAAIQTVVLQRDDLQNGLLSTCRELSRATAELERAWREYDKLEYDVTVTRNQMQEQLDHLGEVQTESAGIQRAQIQKELWRIQDVMEGLSKHKQQRGTTEIGMIGSKPFSTVKYKNEEEEVVPPRPPLPRSYDFTEQPPIIPPLPSDSSSLLCYSRGPVHLPEEKKMYQVQGYPRNGSHCGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPDHETPATEIVQLKETEPQNVDFSKELKKTENISYEMLFEPEPNGVNSVEMMDKKKKK

SEQ ID NO: 2351 - protein, 202 aa, Homo sapiens
MAPLGDLAAESQPSLGRGVVVAIVRADRSPRLGEGGPAAEVYKRMKVGRRGVPAASRTPASFTCHEHHEDRAAPFGRRDGGRNGALEPQHRSLRAQALARCVVSAVPKPAPPSVFVRLCGPRNLGWFGPHLRLRTSAHARQRHPETRASARENTSRHSRNPSVSVPQDLLSLASRWCGRAPARPPVAQSRKWRKAVRGMTNR

SEQ ID NO: 2352 - protein, 349 aa, Homo sapiens
MALLRKINQVLLFLLIVTLCVILYKKVHKGTVPKNDADDESETPEELEEEIPVVICAAAGRMGATMAAINSIYSNTDANILFYVVGLRNTLTRIRKWIEHSKLREINFKIVEFNPMVLKGKIRPDSSRPELLQPLNFVRFYLPLLIHQHEKVIYLDDDVIVQGDIQELYDTTLALGHAAAFSDDCDLPSAQDINRLVGLQNTYMGYLDYRKKAIKDLGISPSTCSFNPGVIVANMTEWKHQRITKQLEKWMQKNVEENLYSSSLGGGVATSPMLIVFHGKYSTINPLWHIRHLGWNPDARYSEHFLQEAKLLHWNGRHKPWDFPSVHNDLWESWFVPDPAGIFKLNHHS

SEQ ID NO: 2353 - protein, 204 aa, Homo sapiens [sequence omitted]

SEQ ID NO: 2354 - protein, 246 aa, Homo sapiens
MGQVASVDCTPPSLQTELLPPWGPRSSLPADCAPCLGTALLPPWGPCSSLPPCGPRSSLPGDRAPPSLRTALGPPWGPRPSLPADRAPPSLGTSLLPPSLRTVLLPPCGLCFSLPWSSLDLPELCQVGPGRPFPGPAVALSFLTCFHSCCPRWALGFVLLLKPFVLNLRGSRDWGIPSKELWLGAQKEGHRVLVGCPGSGPPPLPPPSLPASISVQGSPGPCSPLLSVSAERWPPLSPEGWGRGPG

SEQ ID NO: 2355 - protein, 301 aa, Homo sapiens [sequence omitted]

SEQ ID NO: 2356 - protein, 224 aa, Homo sapiens
MWPQDIAGRHYVVRGPEMTPYEGGYYHGKLIFPREFPFKPPSIYMITPNGRFKCNTRLCLSITDFHPDTWNPAWSVSTILTGLLSFMVEKGPTLGSIETSDFTKRQLAVQSLAFNLKDKVFCELFPEVVEEIKQKQKAQDELSSRPQTLPLPDVVPDGETHLVQNGIQLLNGHAPGAVPNLAGLQQANRHHGLLGGALANLFVIVGFAAFAYTVKYVLRSIAQE

SEQ ID NO: 2357 - protein, 326 aa, Homo sapiens
MAEHPPLLDTTQILSSDISLLSAPIVSADGTQQVILVQVNPGEAFTIRREDGQFQCITGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIRARTVVLTWSPPSSLINGETDESSVPELYGYEVLISSTGKDGKYKSVYV

SEQ ID NO: 2358 - protein, 159 aa, Homo sapiens [sequence omitted]

SEQ ID NO: 2359 - protein, 188 aa, Homo sapiens
MTAPSCAFPVQFRQPSVSGLSQITKSLYISNGVAANNKLMLSSNQITMVINVSVEVVNTLYEDIQYMQVPVADSPNSRLCDFFDPIADHIHSVEMKQGRTLLHCAAGVSRSAALCLAYLMKYHAMSLLDAHTWTKSCRPIIRPNSGFWEQLIHYEFQLFGKNTVHMVSSPVGMIPDIYEKEVRLMIPL

SEQ ID NO: 2360 - protein, 685 aa, Homo sapiens
MAAQGSPSSSPSDDSTTSGSLPELPPTSTATSRSPPESKGSSRSSLLQWTCPEDSLPLAVFYGPLDAKNPLLASCEKEIQELLGFMRKKKALATTEEEKHEFRRRCATSLFNIWTKYAPRLPADYYNEKLLKVGDSLCQMKEYKLALLQCYGRYLQQFNTNFDENKVDVTQFKATFFPKGFKDKTAGLTFHALSGKNMCNYQLVCDSDENLKNKESVVQCLHILSSLRLIMQAALPQEHLCWIIFNGTIYIYTICRKLMVIGQSSKALEYLLWASMCMESLVPLLSLRYLTWRATLYTAVCQCCYDCHAGIHGEAFARRALAKIDELRQLELMSSSKSQEESRRYFREATMKMAVMIFKRGVFESRRKNKAVFRPKIRINLREVQTLSWPRTVTERLLDEMFDSTASQFLAVLEALSDSNRRILQTGPIVTDEVEIHDVVSELFMAGKELLIMSNIGADGMLDFPKTSLLELMIGRKDVISVDAAVKFIKLAFTYEEWSLFESSAVHLIYFLQRQDDPESKKAEKDLTLLIAMEPLINVKRNKGLIFPLENYKEGQSTQIYLKKIAVHDTCLKTCGYSEDIFHLAATLYVCVCTAPQDVQPDKEIVVDTIMFLWQKCKLGIQRLNISRNDYAKFTQKISTNKWIYLLWQINEVIHCYKMEDIDIVVVAEVTLRLSEILESLGSPG

SEQ ID NO: 2361 - protein, 167 aa, Homo sapiens [sequence omitted]

SEQ ID NO: 2362 - protein, 134 aa, Homo sapiens
MHTVTSQKCPPSFCPLRVSSREREKFCRCMWRTASTAADSDSSSGTRPGRGRLLTDSKAALPGASLYFYTVLLRYNLHAIQPIYFKCTMQGVCIYSQSCVSITIVLEHSSLQKKLPTHQQPLPISLICPALGNP

SEQ ID NO: 2363 - protein, 528 aa, Homo sapiens
MEWGVVAAQGVQVTAGDTPKAGARADGEDLTTLSDPLGKEGRRRDPGPAPPCRLVPGAKTQRARRPPGARPCPLPSAGQPAQLRRAGGAAGMARVAWGLLWLLLGSAGAQYEKYSFRGFPPEDLMPLAAAYGHALEQYEGESWRESARYLEAALRLHRLLRDSEAFCHANCSGPAPAAKPDPDGGRADEWACELRLFGRVLERAACLRRCKRTLPAFQVPYPPRQLLRDFQSRLPYQYLHYALFKANRLEKAVAAAYTFLQRNPKHELTAKYLNYYQGMLDVADESLTDLEAQPYEAVFLRAVKLYNSGDFRSSTEDMERALSEYLAVFARCLAGCEGAHEQVDFKDFYPAIADLFAESLQCKVDCEANLTPNVGGYFVDKFVATMYHYLQFAYYKLNDVRQAARSAASYMLFDPKDSVMQQNLVYYRFHRARWGLEEEDFQPREEAMLYHNQTAELRELLEFTHMYLQSDDEMELEETEPPLEPEDALSDAEFEGEGDYEEGMYADWWQEPDAKGDEAEAEPEPELA

SEQ ID NO: 2364 - protein, 134 aa, Homo sapiens [sequence omitted]

SEQ ID NO: 2365 - protein, 576 aa, Homo sapiens
MVAEPPVICSHFAQHFSPEQNIKDSFQKVTPRRYGKCEHENLQLSKSVDECKVQKGGYNGLNQCLPTTQSKIFQCDKYMKIFHKFSNLNGHKVRHTRKKPFKYKEFGKSFCIFSNLTQHKIICTRVNFYKCEDCGKAFNGSSIFTKHKRIHIGEKSYICEECGKACNQFTNLTTHKIIYTRDKLYKREECSKAFNLSSHITTHTIIHTGENPYKREECDKAFNQSSTLTTHKIIHTREKLNEYKECGKAFNQSSHLTRHKIIHTGEKPYKCEECGKAFNQSSHLTRHKIIHTGEKPYKCEECGKAFRQSSHLTTHKIIHTGEKPYKCEECGKAFNKSSHLTRHKSIHTGEKPYQCEKCGKASNQSSNLTEHKNIHTEEKPYKCEECGKAFNQFSNLTTHKRIHTGEKPYKCEECGKAFNQSSILTTHKRIHTGEKSYKCEECGKAFYRSSKLTEHKKIHTGEKPYTCEECGKAFNHSSHLATHKVIHTGEKPYQCEECGKAFNQSSHLTRHKRIHTGEKPYQCEKCGKAFNQSSNLTGHKKIHTGEKLYKPKRCNSDFENTSKFSKHKRNYAGEKS

SEQ ID NO: 2366 - protein, 525 aa, Homo sapiens
MAAAPPLRDRLSFLHRLPILLKGTSDDDVPCPGYLFEEIAKISHESPGSSQCLLEYLLSRLHSSSGHGKLKVLKILLYLCSHGSSFFLLILKRNSAFIQEAAAFAGPPDPLHGNSLYQKVRAAAQDLGSTLFSDTVLPLAPSQPLGTPPATGMGSQARPHSTLQGFGYSKEHGRTAVRHQPGQAGGGWDELDSGPSSQNSSQNSDLSRVSDSGSHSGSDSHSGASREPGDLAERVEVVALSDCQQELSLVRTVTRGPRAFLSREEAQHFIKACGLLNCEAVLQLLTCHLRGTSECTQLRALCAIASLGSSDLLPQEHILLRTRPWLQELSMGSPGPVTNKATKILRHFEASCGQLSPARGTSAEPGPTAALPGPSDLLTDAVPLPGSQVFLQPLSSTPVSSRSPAPSSGMPSSPVPTPPPDASPIPAPGDPSEAEARLAESRRWRPERIPGGTDSPKRGPSSCAWSRDSLFAGMELVACPRLVGAGAAAGESCPDAPRAPQTSSQRTAAKEPPGSEPSAFAFLNA

SEQ ID NO: 2367 - protein, 296 aa, Homo sapiens
MYFSQEEWELLDPTQKALYNDVMQENYETVISLALFVLPKPKVISCLEQGEEPWVQVSPEFKDSAGKSPTGLKLKNDTENHQPVSLSDLEIQASAGVISKKAKVKVPQKTAGKENHFDMHRVGKWHQDFPVKKRKKLSTWKQELLKLMDRHKKDCAREKPFKCQECGKTFRVSSDLIKHQRIHTEEKPYKCQQCDKRFRWSSDLNKHLTTHQGIKPYKCSWCGKSFSQNTNLHTHQRTHTGEKPFTCHECGKKFSQNSHLIKHRRTHTGEQPYTCSICRRNFSRRSSLLRHQKLHL

SEQ ID NO: 2368 - protein, 417 aa, Homo sapiens
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYGWYNVSDQADLVNDLGNKGYLVFGLILFVWELLPTTLLVGFFRVHRPPQDLSTSHILNGQVFASRSYFFDRAGHCEDEGCSWEHSRGESTRCQDQAATTTVSTPPHRRDPPPSPTEYPGPSPPHPRPLCQVCLPLLAQDPGGRGYPLLWPAPCCSCHSELVPSP

SEQ ID NO: 2369 - protein, 767 aa, Homo sapiens
MMASFQRSNSHDKVRRIVAEEGRTARNLIAWSVPLESKDDDGKPKCQTGGKSKRTIQGTHKTTKQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNVSAANLSMAEVLAKKEELADRLEKANEEAIASAIAEEERLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQGQEKEKAREDAARERARDREERLAALTAAQQEAMEELQKKIQLKHDESIRRHMEQI

SEQ ID NO: 2370 - protein, 256 aa, Homo sapiens
MGKTKDIGDDDTVASEFWSGAFSQPSSVPTRPRTPNRDSWRRAWAARGLHPRPSILQPGPARLSRARAGGTRCPQRRHGRATFCALGRGIGVRRGPGPRPARIPGLTLTWKRMSARRMQWAMQTGGRNQTFGGGVPLFWTWLTICCAVWRSLPCRLTHSCSRAFSSAPLKKTKSSMLPPKQALASAARNLCRGAGCNRQAVAGQLLPSTWSLHAHGLAKEAPILPVKKISRSCSVNNKVSEKTTKPPTLRSFLSPI

SEQ ID NO: 2371 - protein, 561 aa, Homo sapiens
MADHNPDSDSTPRTLLRRVLDTADPRTPRRPRSARAGARRALLETASPRKLSGQTRTIARGRSHGARSVGRSAHIQASGHLEEQTPRTLLKNILLTAPESSILMPESVVKPVPAPQAVQPSRQESSCGSLELQLPELEPPTTLAPGLLAPGRRKQRLRLSVFQQGVDQGLSLSQEPQGNADASSLTRSLNLTFATPLQPQSVQRPGLARRPPARRAVDVGAFLRDLRDTSLAPPNIVLEDTQPFSQPMVGSPNVYHSLPCTPHTGAEDAEQAAGRKTQSSGPGLQKNSPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDGLEVFAAHAGRKTVKPEDLELLMRRQGLVTDQVSLHVLVERHLPLEYRQLLIPCAYSGNSVFPAQ

SEQ ID NO: 2372 - protein, 121 aa, Homo sapiens
MGPTEKKRRRRRNASTFLPLNCFGHMLLLLLNSLLLYTNNKFPSCGEEDPPDDLQPLSDPMTLLPPPSDPTAADFGDAVRSRGAWERFASPSVPCPALRPTRVRVAQFVLLRTRSRITGVS

SEQ ID NO: 2373 - protein, 117 aa, Homo sapiens
MTYPHVEPATEREVDSPVHTGVTLRTTEGWFRVPRLFAFCKGACCSRVSSPRKCDHVDCLFPEPYRDTETSREVWKSSLVSLLSFPVSKTQLERELGRPGWRDRNREREKSRRLRGK

SEQ ID NO: 2374 - protein, 102 aa, Homo sapiens [sequence omitted]

SEQ ID NO: 2375 - protein, 525 aa, Homo sapiens
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHREGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 2376 - protein, 676 aa, Homo sapiens
MQGTVAFEDVAVNFSQEEWSLLSEVQRCLYHDVMLENWVLISSLGCWCGSEDEEAPSKKSISIQRVSQVSTPGAGVSPKKAHSCEMCGAILGDILHLADHQGTHHKQKLHRCEAWGNKLYDSSNRPHQNQYLGEKPYRSSVEEALFVKRCKFHVSEESSIFIQSGKDFLPSSGLLLQEATHTGEKSNSKPECESPFQWGDTHYSCGECMKHSSTKHVFVQQQRLPSREECYCWECGKSFSKYDSVSNHQRVHTGKRPYECGECGKSFSHKGSLVQHQRVHTGKRPYECGGCGKSFSHKGSLVQHQRVHTGERPYECGECGKSFSQNGTLIKHQRVHTGERPYECEECGKCFTQKGNLIQHQRGHTSERPYECEECGKCFSQKGTLTEHHRVHTRERPYECGECGKSFSRKGHLRNHQRGHTGERPYECGECGKSFSRKGNLIQHQRSHTGERPYECRECRKLFRGKSHLIEHQRVHTGERPYECNECGKSFQDSSGFRVHQRVHTGEKPFECSECGKSFPQSCSLLRHRRVHTGERPYECGECGKSFHQSSSLLRHQKTHTAERPYECRECGKFFSSLLEHRRVHTGERPYECRECGKTFTRRSAHFKHQRLHTRGKPYECSECGKSFAETFSLTEHRRVHTGERPYECSECGKSFHRSSSLLRHQRVHTERSPYK

SEQ ID NO: 2377 - protein, 297 aa, Homo sapiens
MIRTNFFLKQGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRLERAKKLQEQREKEMVEKQKQQEIAAAAATGGSVLNVAALLASGTQVTPQIAMAAQMAALQAKALAETGIAVPSYYNPAAVNPRNLLNKRKKGKCFGRARKKGTNPNLLKYGKN

SEQ ID NO: 2378 - protein, 120 aa, Homo sapiens
MLAPFSYNWSQRGWDTGCHVPRLHRAEGPIKPFFPPSPPGLWWEGLPQRSLTCPGDISPLSWLLTFGSSVQISITYLNLSPKNGFFFSTTWSGCKFSKLVCFASHLNISYNFRTSLCSCI

SEQ ID NO: 2379 - protein, 113 aa, Homo sapiens [sequence omitted]

SEQ ID NO: 2380 - protein, 166 aa, Homo sapiens
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEHVSMACVHLASKIEEAPRRIRDVINVFHRLRQLRDKKKPVPLLLD

SEQ ID NO: 2381 - protein, 219 aa, Homo sapiens [sequence omitted]

SEQ ID NO: 2382 - protein, 560 aa, Homo sapiens [sequence omitted]

SEQ ID NO: 2383 - protein, 110 aa, Homo sapiens
MQIPTREMSRGRLLSEVLQPKGCSIAIPFPWSCQLFSGQGPWGRWSKPSPQAGGLESTRKGSTWFYEAILGGATPHLPPTYTFCCRKCLIPHDVSLSFQQKKVKLWVVEP

SEQ ID NO: 2384 - protein, 667 aa, Homo sapiens [sequence omitted]

SEQ ID NO: 2385 - protein, 626 aa, Homo sapiens
MSKKGRSKGEKPEMETDAVQMANEELRAKLTSIQIEFQQEKSKVGKLRERLQEAKLEREQEQRRHTAYISELKAKLHEEKTKELQALREGLIRQHEQEAARTAKIKEGELQRLQATLNVLRDGAADKVKTALLTEAREEARRAFDGERLRLQQEILELKAARKQAEEALSNCMQADKTKAADLRAAYQAHQDEVHRIKRECERDIRRLMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEVRDSICCKLSNGADILFEPKLKFM

SEQ ID NO: 2386 - protein, 427 aa, Homo sapiens
MAGEAHHTQRGTLSQEPLSPRLSECREASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSHRLMVVLALFWQPAHPRDTSTLCPSCMYHWGRNLGSVFTTAAAWSHEFFPSAADSLQGGSSLPPPLLKLQSTGYGSGWFPQGSSSGEHPSVWGTVFLFVPAPDPGSLGQRPHQTRLAALGQLHGCWSGAR

SEQ ID NO: 2387 - protein, 607 aa, Homo sapiens [sequence omitted]

SEQ ID NO: 2388 - protein, 167 aa, Homo sapiens
MHCPTTIAACPTIMCSTLARLVATPASPIQQLAWPDTTHPTCTLGQRATHHGPCPTASVPCWAPGPRSPRLCSTTSCPGPSWHPSRSARTGRSVSACCAPRPTHSSATQASMMLPAPTACSRPVCCLRASEVLRCATALQMTLWPGPASAAPATLSCRHHCPRFPAP

SEQ ID NO: 2389 - protein, 180 aa, Homo sapiens [sequence omitted]

SEQ ID NO: 2390 - protein, 262 aa, Homo sapiens
MGKTFSQLGSWREDENKSILSSKPAIGSKAVNYSSTGSSKSFCSCVPCEGTADASFVTCPTCQGSGKIPQELEKQLVALIPYGDQRLKPKHTKLFVFLAVLICLVTSSFIVFFLFPRSVIVQPAGLNSSTVAFDEADIYLNITNILNISNGNYYPIMVTQLTLEVLHLSLVVGQVSNNLLLHIGPLASEQMFYAVATKIRDENTYKICTWLEIKVHHVLLHIQGTLTCSYLSHSEQLVFQSYEYVDCRGNASVPHQLTPHPP

SEQ ID NO: 2391 - protein, 186 aa, Homo sapiens
MWLVECTGRDLTGLSCLLGMDRQPRRRQHVAGCRDVPPPLPQGSWGQTSPRHSILCSKSGCDLLGGGEYNGETSGEEFLAPAWTCRAQQAATWLSVQQTSHKALGPAGGAAMSSKLSPEEQFLSRIHFLRTFMCSVAGAELPGIPQATENGEGCRPARDPASSPSSLSMASVYTQCSSAQLVSALS

SEQ ID NO: 2392 - protein, 846 aa, Homo sapiens
MLFKLLQRQTYTCLSHRYGLYVCFLGVVVTIVSAFQFGEVVLEWSRDQYHVLFDSYRDNIAGKSFQNRLCLPMPIDVVYTWVNGTDLELLKELQQVREQMEEEQKAMREILGKNTTEPTKKSEKQLECLLTHCIKVPMLVLDPALPANITLKDLPSLYPSFHSASDIFNVAKPKNPSTNVSVVVFDSTKDVEDAHSGLLKGNSRQTVWRGYLTTDKEVPGLVLMQDLAFLSGFPPTFKETNQLKTKLPENLSSKVKLLQLYSEASVALLKLNNPKDFQELNKQTKKNMTIDGKELTISPAYLLWDLSAISQSKQDEDISASRFEDNEELRYSLRSIERHAPWVRNIFIVTNGQIPSWLNLDNPRVTIVTHQDVFRNLSHLPTFSSPAIESHIHRIEGLSQKFIYLNDDVMFGKDVWPDDFYSHSKGQKVYLTWPVPNCAEGCPGSWIKDGYCDKACNNSACDWDGGDCSGNSGGSRYIAGGGGTGSIGVGQPWQFGGGINSVSYCNQGCANSWLADKFCDQACNVLSCGFDAGDCGQDHFHELYKVILLPNQTHYIIPKGECLPYFSFAEVAKRGVEGAYSDNPIIRHASIANKWKTIHLIMHSGMNATTIHFNLTFQNTNDEEFKMQITVEVDTREGPKLNSTAQKGYENLVSPITLLPEAEILFEDIPKEKRFPKFKRHDVNSTRRAQEEVKIPLVNISLLPKDAQLSLNTLDLQLEHGDITLKGYNLSKSALLRSFLMNSQHAKIKNQAIITDETNDSLVAPQEKQVHKSILPNSLGVSERLQRLTFPAVSVKVNGHDQGQNPPLDLETTARFRVETHTQKTIGGNVTKEKPPSLIVPLESQM

SEQ ID NO: 2393 - protein, 475 aa, Homo sapiens
MEMASSAGSWLSGCLIPLVFLRLSVYVSGHAGDAGKFHVALLGGTAELLCPLSLWPGTVPKEVRWLRSPFPQRSQAVHIFRDGKDQDEDLMPEYKGRTVLVRDAQEGSVTLQILDVRLEDQGSYRCLIQVGNLSKEDTVILQVAAPSVGSLSPSAVALAVILPVLVLLIMVCLCLIWKQRRAKEKLLYEHVTEVDNLLSDHAKEKGKLHKAVKKLRSELKLKRAAANSGWRRARLHFVAVTLDPDTAHPKLILSEDQRCVRLGDRRQPVPDNPQRFDFVVSILGSEYFTTGCHYWEVYVGDKTKWILGVCSESVSRKGKVTASPANGHWLLRQSRGNEYEALTSPQTSFRLKEPPRCVGIFLDYEAGVISFYNVTNKSHIFTFTHNFSGPLRPFFEPCLHDGGKNTAPLVICSELHKSEESIVPRPEGKGHANGDVSLKVNPSLLPPKAPELKDIILSLPPDLGPALQELKAPSF

SEQ ID NO: 2394 - protein, 304 aa, Homo sapiens
MLAVRKARRKLRMGTICSPNPSGTKTSSEVCNADWMASLPPHLHNLPLSNLAIPGSHDSFSYWVDEKSPVGPDQTQAIKRLARISLVKKLMKKWSVTQNLTFREQLEAGIRYFDLRVSSKPGDADQEIYFIHGLFGIKVWDGLMEIDSFLTQHPQEIIFLDFNHFYAMDETHHKCLVLRIQEAFGNKLCPACSVESLTLRTLWEKNCQVLIFYHCPFYKQYPFLWPGKKIPAPWANTTSVRKLILFLETTLSERASRGSFHVSQAILTPRVKTIARGLVGGLKNTLVHRLALIPVYPLRFSRRS

SEQ ID NO: 2395 - protein, 150 aa, Homo sapiens
MRYACSSSEDWPPPLDISSDGDVDATVLRELYPDSPPGYEECVGPGATQLYVPTDAPPPYSLTDSCPTLDGTSDSGSGHSPGRHQQEQRTPAQGGLHTVSMDTLPPYEAVCGAGPPSGLLPLPGPDPGPRGSQGSPTPTRAPASGPERIV

SEQ ID NO: 2396 - protein, 325 aa, Homo sapiens [sequence omitted]

SEQ ID NO: 2397 - protein, 449 aa, Homo sapiens
MSDIRHSLLRRDALSAAKEVLYHLDIYFSSQLQSAPLPIVDKGPVELLEEFVFQVPKERSAQPKRLNSLQELQLLEIMCNYFQEQTKDSVRQIIFSSLFSPQGNKADDSRMSLLGKLVSMAVAVCRIPVLECAASWLQRTPVVYCVRLAKALVDDYCCLVPGSIQTLKQIFSASPRFCCQFITSVTALYDLSSDDLIPPMDLLEMIVTWIFEDPRLILITFLNTPIAANLPIGFLELTPLVGLIRWCVKAPLAYKRKKKPPLSNGHVSNKVTKDPGVGMDRDSHLLYSKLHLSVLQVLMTLQLHLTEKNLYGRLGLILFDHMVPLVEEINRLADELNPLNASQEIELSLDRLAQALQVAMASGALLCTRDDLRTLCSRLPHNNLLQLVISGPVQQSPHAALPPGFYPHIHTPPLGYGAVPAHPAAHPALPTHPGHTFISGVTFPFRPIR

SEQ ID NO: 2398 - protein, 154 aa, Homo sapiens
MTPTYLSVQLSSLFLFFFFLFLSFCLSFFLSFFLSFFLSFFFFLSFFLFLSFSFLPSFLPSFFLFLYLFLSFFLSLLSLFFETESRTLAQAGGQWCHLGSLQAPPPGFTPFSCLSLRSSWYYRRPSPRPANFFEFLVETEFHRISQDGLDLLTL

SEQ ID NO: 2399 - protein, 289 aa, Homo sapiens
MNRRMVGPDVIPLPHIYGARIKGVEVFCPLDPPPPYEAVVSQMDQEQGSSFQMSEGSEAAVIPLDLGCIQVTQDGDIPNIPAEENASTSTPSSTLVRPIRSRRALPPLRTRSKSDPVLHPSEERAAPVLSCEAATQTERRLDLAAVTLRRGLRSRASRCRPRSLIDYKSYMDTKLLVARFLEQSSCTMTPDIHELVENIKSVLKSDEEHMEEAITSASFLEQIMAPLQPSTSRAHKLPSRRQPGLLHLQSCGDLHTFTPAGRPRAERRPRRVEAERPHSLIGVIRETVL

SEQ ID NO: 2400 - protein, 545 aa, Homo sapiens [sequence omitted]

SEQ ID NO: 2401 - protein, 730 aa, Homo sapiens
MEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSQIRKLRRELESSQEKVATLTSQLSANANLVAAFEQSLVNMTSRLRHLAETAEEKMEFRSCHPGWSALARSWLTANSASQDTELLDLRETIDFLKKKNSEAQAVIQGALNASETTPKELRIKRQNSSDSISSLNSITSHSSIGSSKDADA

SEQ ID NO: 2402 - protein, 580 aa, Homo sapiens
MLESVLLELQNFSESQEVEVSSGSQVSAAPAPRASVATDGPHPSGLTDSLDYPGERASNGMSSDLPPKKSKDKLDKKKEVVKPPYPKIRRASGRLAGRKVFVEIPKKKYTRRLREQQKTAEGDVGDYRCPQDQSPDRVGTEMEPVSKNEGCQAGAELEELSKKAGPEEEEEEEEEDEEGEKKKSNFKCSICEKAFLYEKSFLKHSKHRHGVATEVVYRCDTCGQTFANRCNLKSHQRHVHSSERHFPCELCGKKFKRKKDVKRHVLQVHEGGGERHRCGQCGKGLSSKTALRLHERTHTGDRPYGCTECGARFSQPSALKTHMRIHTGEKPFVCDECGARFTQNHMLIYHKRCHTGERPFMCETCGKSFASKEYLKHHNRIHTGSKPFKCEVCFRTFAQRNSLYQHIKVHTGERPYCCDQCGKQFTQLNALQRHRRIHTGERPFMCNACGRTFTDKSTLRRHTSIHDKNTPWKSFLVIVDGSPKNDDGHKTEQPDEEYVSSKLSDKLLSFAENGHFHNLAAVQDTVPTMQENSSADTACKADDSVVSQDTLLATTISELSELTPQTDSMPTQLHSLSNME

SEQ ID NO: 2403 - protein, 637 aa, Homo sapiens
MFLLLLHLQIKWRATINLLSVTEDGLHFVEYYLNRIIHLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEETEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYGYNSQYDEAVAQFSKSIEVIENRMAVLNEQVKEAEGSSAEY

SEQ ID NO: 2404 - protein, 523 aa, Homo sapiens
METMKSKANCAQNPNCNIMIFHPTKEEFNDFDKYIAYMESQGAHRAGLAKIIPPKEWKARETYDNISEILIATPLQQVASGRAGVFTQYHKKKKAMTVGEYRHLANSKKYQTPPHQNFEDLERKYWKNRIYNSPIYGADISGSLFDENTKQWNLGHLGTIQDLLEKECGVVIEGVNTPYLYFGMWKTTFAWHTEDMDLYSINYLHLGEPKTWYVVPPEHGQRLERLARELFPGSSRGCGAFLRHKVALISPTVLKENGIPFNRITQEAGEFMVTFPYGYHAGFNHGFNCAEAINFATPRWIDYGKMASQCSCGEARVTFSMDAFVRILQPERYDLWKRGQDRAVVDHMEPRVPASQELSTQKEVQLPRRAALGLRQLPSHWARHSPWPMAARSGTRCHTLVCSSLPRRSAVSGTATQPRAAAVHSSKKPSSTPSSTPGPSAQIIHPSNGRRGRGRPPQKLRAQELTLQTPAKRPLLAGTTCTASGPEPEPLPEDGALMDKPVPLSPGLQHPVKASGCSWAPVP

SEQ ID NO: 2405 - protein, 454 aa, Homo sapiens [sequence omitted]

SEQ ID NO: 2406 - protein, 139 aa, Homo sapiens
MVTHAAGARTFCEEQKKGSTYSVPKSKEKLMEKHSQEARQADRESEKPVDSLHPGAGTAKHPPPAASLEEKPDVKQKSSRKKVVVPQIIITRASNETLVSCSSSGSDQQRTIREPEDWGPYRRHRNPSTADAYNSHLKE

SEQ ID NO: 2407 - protein, 190 aa, Homo sapiens
MIISSNADRLLDPQKLEDRSAPWLTWACQSCRAEPSPPEDCTGLNCAYKESLQINRNFSSRAGIGRAGMEMRLWNERSLSTWGKWHFTRNIKYLGGRTCEGQGTPRGGTYLPLRKCGCSEGLASLVQKRTEAHPQQTFLLPDPQRPLPGGGGRSKENRLRVTTYQASPGLVRIRSPGGARTLSPLCNQAV

SEQ ID NO: 2408 - protein, 153 aa, Homo sapiens [sequence omitted]

SEQ ID NO: 2409 - protein, 557 aa, Homo sapiens
MKKMSNIYESAANTLGIFNSPCLTKVELRVACKGISDRDALSKPDPCVILKMQSHGQWFEVDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDKDFFSKSDPFLEIFRMNDDATQQLVHRTEVVMNNLSPAWKSFKVSVNSLCSGDPDRRLKCIVWDWDSNGKHDFIGEFTSTFKEMRGAMEGKQVQWECINPKYKAKKKNYKNSGTVILNLCKIHKMHSFLDYIMGGCQIQFTVAIDFTASNGDPRNSCSLHYIHPYQPNEYLKALVAVGEICQDYDSDKMFPAFGFGARIPPEYTVSHDFAINFNEDNPECAGIQGVVEAYQSCLPKLQLYGPTNIAPIIQKVAKSASEETNTKEASQYFILLILTDGVITDMADTREAIVHASHLPMSVIIVGVGNADFSDMQMLDGDDGILRSPKGEPVLRDIVQFVPFRNFKHASPAALAKSVLAEVPNQVVDYYNGKGIKPKCSSEMYESSRTLAP

SEQ ID NO: 2410 - protein, 189 aa, Homo sapiens
MEADGDGEELARLRSVFAACDANRSGRLEREEFRALCTELRVRPADAEAVFQRLDADRDGAITFQEFARGFLGSLRGGRRRDWGPLDPAPAVSEAGPETHDSEEDEGDEDAAAALATSCGPASPGRAWQDFQARLGDEAKFIPRFGYTISKPAFVFVRHLITLCALSWAKKEGRETLWTIEEGGAKMAE

SEQ ID NO: 2411 - protein, 204 aa, Homo sapiens
MGAPLAVALGALHYLALFLQLGGATRPAGHAPWDNHVSGHALFTETPHDMTARTGEDVEMACSFRGSGSPSYSLEIQWWYVRSHRDWTDKQAWASNQLKASQQEDAGKEATKISVVKVVGSNISHKLRLSRVKPTDEGTYECRVIDFSDGKARHHKVKAYLRVQPGENSVLHLPEAPPAAPAPPPPKPGKELRKRSVDQEACSL

SEQ ID NO: 2412 - protein, 104 aa, Homo sapiens
MATALLENYLKDQKGPGEAYFLGFSSWTRKEWFHSASRRSWSLSLSASGSCLLCFGSEEVSDSFDTSGNLNQAVKPRPPYVKIKVVSLWLHQDVCVRLSQQGGE

SEQ ID NO: 2413 - protein, 132 aa, Homo sapiens
MASPSWHLGMVHLTSSVPWWPSLTRTQPAWPLGHCLVRAAPVRGAGKAAGEGAGWLSSGLLPPGAGVLVTTVVAGGITILHPFMAASRPFFRDIVFYMVAVFLTFLMLFRGRVTLAWALGEQLWGSGVRSQG

SEQ ID NO: 2414 - protein, 110 aa, Homo sapiens [sequence omitted]

SEQ ID NO: 2415 - protein, 484 aa, Homo sapiens [sequence omitted]

SEQ ID NO: 2416 - protein, 699 aa, Homo sapiens [sequence omitted]

SEQ ID NO: 2417 - protein, 720 aa, Homo sapiens
MVGLHFLTNLILEKDGDDNPVCRLPGYRAVILQTLPQLRILDCKNIFGEPVNLTEINSSQLQCLEGLLDNLVSSDSPLNISEDEIIDRMPVITAPIDELVPLEQFASTPSDAVLTSFMSVCQSSEPEKNNHENDLQNEIKLQKLDDQILQLLNETSNSIDNVLEKDPRPKRDTDITSESDYGNRKECNRKVPRRSKIPYDAKTIQTIKHHNKNYNSFVSCNRKMKPPYLKELYVSSSLANCPMLQESEKPKTEIIKVDQSHSEDNTYQSLVEQLDQEREKRWRAEQAENKLMDYIDELHKHANEKEDIHSLALLTTDRLKEIIFRERNSKGQLEVMVHKLQNEIKKLTVELMKAKDQQEDHLKHLRTLEKTLEKMERQKRQQQAAQIRLIQEVELKASAADREIYLLRTSLHREREQAQQLHQLLALKEQEHRKELETREFFTDADFQDALAKEIAKEEKKHEQMIKEYQEKIDVLSQQYMDLENEFRIALTVEARRFQDVKDGFENVATELAKSKHALIWAQRKENESSSLIKDLTCMVKEQKTKLAEVSKLKQETAANLQNQINTLEILIEDDKQKSIQIELLKHEKVQLISELAAKESLIFGLRTERKVWGHELAQQGSSLAQNRGKLEAQIESLSRENECLRKTNESDSDALRIKCKIIDDQTETIRKLKDCLQEKDEHIKRLQEKITEIEKCTQEQLDEKSSQLDEVLEKLERHN

SEQ ID NO: 2418 - protein, 748 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLVSEEATLSHPNFPKATPKGGGSPRSPRTDMRPPPGPCGAGPGSESNLFIDCPEGLENRPNLEGLDFFLGWNAALRVGLALTQETAVPNPWTGPAGAHMLTQTHSETLRHWTRPPLSLLFVQISKAG

SEQ ID NO: 2419 - protein, 128 aa, Homo sapiens [sequence omitted]

SEQ ID NO: 2420 - protein, 417 aa, Homo sapiens
MTQLLLKFGDKSLFQPQPNEMDIRASEHWISDNMVKSKTELKQNNQSLASKKYQSDMYWAQSQDGLGDSAYGSHPGPASSRRLQELELDHGASGYNHDETQWYEDSLECLSDLKPEQSVRDSMDSLALSNITGASVDGENKPRPSLYSLQNFEEMETEDCEKMSNMGTLNSSMLHRSAESLKSLSSELCPEKILPEEKPVHLPVLRRSKSQSRPQQVKFSDDVIDNGNYDIEIRQPPMSERTRRRVYNFEERGSRSHHHRRRRSRKSRSDNALNLVTERKYSPKDRLRLYTPDNYEKFIQNKSAREIQAYIQNADLYGQYAHATSDYGLQNPGMNRFLGLYGEDDDSWCSSSSSSSDSEEEGYFLGQPIPQPRPQRFAYYTDDLSSPPSALPTPQFGQRTTKSKKKKGHKGKNCIIS

SEQ ID NO: 2421 - protein, 345 aa, Homo sapiens
MNAPLDGLSVSSSSTGSLGSAAGAGGGGGAGLRLLSANVRQLHQALTALLSEAEREQFTHCLNAYHARRNVFDLVRTLRVLLDSPVKRRLLPMLRLVIPRSDQLLFDQYTAEGLYLPATTPYRQPAWGGPDSAGPGEVRLVSLRRAKAHEGLGFSIRGGSEHGVGIYVSLVEPGSLAEKEGLRVGDQILRVNDKSLARVTHAEAVKALKGSKKLVLSVYSAGRISGGYVTNHIYTWVDPQGRSISPPSGLPQPHGGALRQQEGDRRSTLHLLQGGDEKKVSGVGKGGQPLRHRILPPNPEQQSCLEAARRGWFCPGSVFPQVCTEGWCFFFAFLFDLCSVCYNTG

SEQ ID NO: 2422 - protein, 254 aa, Homo sapiens
MVSWIISRLVVLIFGTLYPAYSSYKAVKTKNVKEYVKWMMYWIVFAFFTTAETLTDIVLSWFPFYFELKIAFVIWLLSPYTKGSSVLYRKFVHPTLSNKEKEIDEYITQARDKSYETMMRVGKRGLNLAANAAVTAAAKGQGVLSEKLRSFSMQDLTLIRDEDALPLQRPDGRLRPSPGSLLDTIEDLGDDPALSLRSSTNPADSRTEASEDDMGDKAPKRAKPIKKAPKAEPLASKTLKTRPKKKTSGGGDSA

SEQ ID NO: 2423 - protein, 618 aa, Homo sapiens
MAAVAAGGLVGKGRDISLAALQRHDPYINRIVDVASQVALYTFGHRANEWEKTDVEGTLFVYTRSASPKHGFTIMNRLSMENRTEPITKDLDFQLQDPFLLYRNARLSIYGIWFYDKEECQRIAELMKNLTQYEQLKAHQGTGAGISPVILNSGEGKEVDILRMLIKAKDEYTKCKTCSEPKKITSSSAIYDNPNLIKPIPVKPSENQQQRIPQPNQTLDPEPQHLSLTALFGKQDKATCQETVEPPQTLHQQQQQQQQQQQEKLPIRQGVVRSLSYEEPRRHSPPIEKQLCPAIQKLMVRSADLHPLSELPENRPCENGSTHSAGEFFTGPVQPGSPHNIGTSRGVQNASRTQNLFEKLQSTPGAANKCDPSTPAPASSAALNRSRAPTSVTPVAPGKGLAQPPQAYFNGSLPPQTVGHQAHGRERSTLPRQTLPISGSQTGSSGVISPQELLKKLQIVQQEQQLHASNRPALAAKFPVLAQSSGTGKPLESWINKTPNTEQQTPLFQVISPQRIPATAAPSLLMSPMVFAQPTSVPPKERESGLLPVGGQEPPAAATSLLLPIQSPEPSVITSSPLTKLQLQEALLYLIQNDDNFLNIIYEAYLFSMTQAAMKKTM

SEQ ID NO: 2424 - protein, 690 aa, Homo sapiens [sequence omitted]

SEQ ID NO: 2425 - protein, 696 aa, Homo sapiens [sequence omitted]

SEQ ID NO: 2426 - protein, 332 aa, Homo sapiens
MPEGPLVRKFHHLVSPFVGQQVVKTGGSSKKLQPASLQSLWLQDTQVHGKKLFLRFDLDEEMGPPGSSPTPEPPQKEVQKEGAADPKQVGEPSGQKTLDGSSRSAELVPQGEDDSEYLERDAPAGDAGRWLRVSFGLFGSVWVNDFSRAKKANKRGDWRDPSPRLVLHFGGGGFLAFYNCQLSWSSSPVVTPTCDILSEKFHRGQALEALGQAQPVCYTLLDQRYFSGLGNIIKNEALYRAGIHPLSLGSVLSASRREVLVDHVVEFSTAWLQGKFQGRPQHTQVYQKEQCPAGHQVMKEAFGPEDGLQRLTWWCPQCQPQLSEEPEQCQFS

SEQ ID NO: 2427 - protein, 330 aa, Homo sapiens
MLRSGQMMLAQGLLLHFLPRDWTWAEGMGLGPPELSGSASPSRYHGPARWMPPRWAQGAPELERERRHRQIVSWFADHPRAPFGLHRLVELGQSSGKKAGDWYGPSLVAHILRKAVESCSDVTRLVVYVSQDCTVYKADVARLVARPDPTAEWKSVVILVPVRLGGETLNPVYVPCVKELLRCELCLGIMGGKPRHSLYFIGYQDDFLLYLDPHYCQPTVDVSQADFPLESFHCTSPRKMAFAKTDPSCTVGFYAGDRKEFGTLCSELTRVLSSSSATERYPMFTLAEGHAQDHSLDDLCSQLAQPTLRLPRTGRLLRAKRPSSEDFVFL

SEQ ID NO: 2428 - protein, 118 aa, Homo sapiens [sequence omitted]

SEQ ID NO: 2429 - protein, 107 aa, Homo sapiens; identical to SEQ ID NO: 1811

SEQ ID NO: 2430 - protein, 543 aa, Homo sapiens
MSATSVDQRPKGQGNKVSVQNGSIHQKDAVNDDDFEPYLSSQTNQSNSYPPMSDPYMPSYYAPSIGFPYSLGEAAWSTAGDQPMPYLTTYGQMSNGEHHYIPDGVFSQPGALGNTPPFLGQHGFNFFPGNADFSTWGTSGSQGQSTQSSAYSSSYGYPPSSLGRAITDGQAGFGNDTLSKVPGISSIEQGMTGLKIGGDLTAAVTKTVGTALSSSGMTSIATNSVPPVSSAAPKPTSWAAIARKPAKPQPKLKPKGNVGIGGSAVPPPPIKHNMNIGTWDEKGSVVKAPPTQPVLPPQTIIQQPQPLIQPPPLVQSQLPQQQPQPPQPQQQQGPQPQAQPHQVQPQQQQLQNRWVAPRNRGAGFNQNNGAGSENFGLGVVPVSASPSSVEVHPVLEKLKAINNYNPKDFDWNLKNGRVFIIKSYSEDDIHRSIKYSIWCSTEHGNKRLDAAYRSLNGKGPLYLLFSVNGSGHFCGVAEMKSVVDYNAYAGVWSQDKWKGKFEVKWIFVKDVPNNQLRHIRLENNEKRQEEEEAMRRERNRNKQ

SEQ ID NO: 2431 - protein, 157 aa, Homo sapiens
MEGCAVRRGSCPLLPGPSAWRASPAGWAGRAKLRSWCRASGLPNRPYTLTGGRHGSVSLLRHPGTTTFVQQRSLHQSWEKRIVFSACPVSRSWCPERNFSGSIPAVTPPKLPGHSKSEGPPGKVRKRTTIRSQPLFVTRTRGFGSAVGWLPLGSPVL

SEQ ID NO: 2432 - protein, 124 aa, Homo sapiens
MGRELTHAASTESSDPHTGTSTLCFPSCRRCPATHNDYHLPSLKNFSLNPAAQTAKSSLLSEGSSHYVHFCTPLSFYITFIFLKKSSEAGGLLEFRRSRPAWATYPNPISTKNIKIRHCGHTRP

SEQ ID NO: 2433 - protein, 232 aa, Homo sapiens
MLGAMFRAGTPMPPNLNSQGGGHYFIDRDGKAFRHILNFLRLGRLDLPRGYGETALLRAEADFYQIRPLLDALRELEASQGTPAPTAALLHADVDVSPRLVHFSARRGPHHYELSSVQVDTFRANLFCTDSECLGALRARFGVASGDRAEGSPHFHLEWAPRPVELPEVEYGRLGLQPLWTGGPGERREVVGTPSFLEEVLRVALEHGFRLDSVFPDPEDLLNSRSLRFVRH

SEQ ID NO: 2434 - protein, 108 aa, Homo sapiens [sequence omitted]

SEQ ID NO: 2435 - protein, 102 aa, Homo sapiens
MKWSHLPFQIKLGRDSATQGHISSAAKRRGKILQCGCANRTTSGEQRPLFQTKRSLDYHSHIPWSSGAARILRVLQWSEAVDAEILKLGRGSRRQVIFLDLP

SEQ ID NO: 2436 - protein, 128 aa, Homo sapiens
MPIVDFHLQKLPAAAAAPFLDKSHSSSPGSPKTAELFFTERTPWFHQFPQIPVAPDLSSRGTRRKDFLSTRRILGAAKVPVVSFYHSRGVLLKASERASGGSKAVQPGRKEKETPRHRKPRFSRRKNR

SEQ ID NO: 2437 - protein, 264 aa, Homo sapiens
MLGAETEEKLFDAPLSISKREQLEQQVPENYFYVPDLGQVPEIDVPSYLPDLPGIANDLMYIADLGPGIAPSAPGTIPELPTFHTEVAEPLKADLQDGVLTPPPPPPPPPPAPEVLASAPPLPPSTAAPVGQGARQDDSSSSASPSVQGAPREVVDPSGGRATLLESIRQAGGIGKAKLRSMKERKLEKKKQKEQEQVRATSQGGHLMSDLFNKLVMRRKGISGKGPGAGEGPGGAFARVSDSIPPLPPPQQPQAEEDEDDWES

SEQ ID NO: 2438 - protein, 396 aa, Homo sapiens [sequence omitted]

SEQ ID NO: 2439 - protein, 760 aa, Homo sapiens
MIITEDSLPSLEAILNYSIFNRENDLLAQFDAIPGKKGTRVLIWNIRRNKNGKSELDFDTDQYDILVSDFDTEEKMTGGVTSELPETEYSLRAFCGILYMKPRMKIFLRQKKVTTQMIAKSLANVEYDTHKPTFTNKQVRITFGFSCKNSNQFGIMMYHNNRLIKSFEKVGCQVKPTRGEGVGVIGVIECNFLKPAYNKQDFEYTKEYRLTINALAQKLNAYWKEKTSQDNFETSTVARPIPKVPDQTWVQCDECLKWRKLPGKIDPSMLPARWFCYYNSHPKYRRCSVPEEQELIDEDLCLSKAKKQEQTVEEKKKMPMENENHQVFSNPPKILTVQEMAGLNNKTIGYEGIHSPSVLPSGGEESRSPSLQLKPLDSSVLQFSSKYKWILGEEPVEKRRRLQNEMTTPSLDYSMPAPYRRVEAPVAYPEGENSHDKSSSERSTPPYLFPEYPEASKNTGQNREVSILYPGAKDQRQGSLLPEELEDQMPRLVAEESNRGSTTINKEEVNKGPFVAVVGVAKGVRDSGAPIQLIPFNREELAERRKAVESWNPVPYSVASAAIPAAAIGEKARGYEESEGHNTPKLKNQRELEELKRTTEKLERVLAERNLFQQKVEELEQERNHWQSEFKKVQHELVIYSTQEAEGLYWSKKHMGYRQAEFQILKAELERTKEEKQELKEKLKETETHLEMLQKAQVSYRTPEGDDLERALAKLTRLRIHVSYLLTSVLPHLELREIGYDSEQVDGILYTVLEANHILD

SEQ ID NO: 2440 - protein, 651 aa, Homo sapiens [sequence omitted]

SEQ ID NO: 2441 - protein, 336 aa, Homo sapiens
MKTLMRHGLAVCLALTTMCTSLLLVYSSLGGQKERPPQQQQQQQQQQQQASATGSSQPAAESSTQQRPGVPAGPRPLDGYLGVADHKPLKMHCRDCALVTSSGHLLHSRQGSQIDQTECVIRMNDAPTRGYGRDVGNRTSLRVIAHSSIQRILRNRHDLLNVSQGTVFIFWGPSSYMRRDGKGQVYNNLHLLSQVLPRLKAFMITRHKMLQFDELFKQETGKDRKISNTWLSTGWFTMTIALELCDRINVYGMVPPDFCRDPNHPSVPYHYYEPFGPDECTMYLSHERGRKGSHHRFITEKRVFKNWARTFNIHFFQPDWKPESLAINHPENKPVF

SEQ ID NO: 2442 - protein, 665 aa, Homo sapiens [sequence omitted]

SEQ ID NO: 2443 - protein, 707 aa, Homo sapiens
MSVNISTAGKGVDPNTVDTYDSGDDWEIGVGNLIIDLDADLEKDRQKFEMNNSTTTTSSSNSKDCGGPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPLFTVPAPPPPISSSLTPQILPSYFSPSSSNIAAPVEQLLVRTRSVGVNTCEVGVVTEPECLGPCEPGTSVNLEGIVWHETEEGVLVVNVTWRNKTYVGTLLDCTKHDWAPPRFCESPTSDLEMRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLID

SEQ ID NO: 2444 - protein, 367 aa, Homo sapiens [sequence omitted]

SEQ ID NO: 2445 - protein, 153 aa, Homo sapiens [sequence omitted]

SEQ ID NO: 2446 - protein, 608 aa, Homo sapiens
MTSVGVFSDMLNGCGKDGLVPRAKPRDVSDFSLYAPATKPCCSRTYKRRRLRAPALTGLGPVTSLIAPSSLSAAMIARQQCVRGGPRGFSCGSAIVGGGKRGAFSSVSMSGGAGRCSSGGFGSRSLYNLRGNKSISMSVAGSRQGACFGGAGGFGTGGFGAGGFGAGFGTGGFGGGFGGSFSGKGGPGFPVCPAGGIQEVTINQSLLTPLHVEIDPEIQKVRTEEREQIKLLNNKFASFIDKVQFLEQQNKVLETKWNLLQQQTTTTSSKNLEPLFETYLSVLRKQLDTLGNDKGRLQSELKTMQDSVEDFKTKYEEEINKRTAAENDFVVLKKDVDAAYLNKVELEAKVDSLNDEINFLKVLYDAELSQMQTHVSDTSVVLSMDNNRNLDLDSIIAEVRAQYEEIAQRSKAEAEALYQTKVQQLQISVDQHGDNLKNTKSEIAELNRMIQRLRAEIENIKKQCQTLQVSVADAEQRGENALKDAHSKRVELEAALQQAREELARMLREYQELMSVKLALDIEIATYRKLLEGEEYRMSGECQSAVSISVVSGSTSTGGISGGLGSGSGFGLSSGFGSGSGSGFGFGGSVSGSSSSKIISTTTLNKRR

SEQ ID NO: 2447 - protein, 333 aa, Homo sapiens
MAASDTERDGLAPEKTSPDRDKKKEQSEVSVSPRASKHHYSRSRSRSRERKRKSDNEGRKHRSRSRSKEGRRHESKDKSSKKHKSEEHNDKEHSSDKGRERLNSSENGEDRHKRKERKSSRGRSHSRSRSRERRHRSRSRERKKSRSRSRERKKSRSRSRERKKSRSRSRERKRRIRSRSRSRSRHRHRTRSRSRTRSRSRDRKKRIEKPRRFSRSLSRTPSPPPFRGRNTAMDAQEALARRLERAKKLQEQREKEMVEKQKQQEIAAAAAATGGSVLNVAALLASGTQVTPQIAMAAQMAALQAKALAETGIAVPSYYNPAAVNPMKFAEQE

SEQ ID NO: 2448 - protein, 473 aa, Homo sapiens
MPQTPPFSAMFDSSGYNRNLYQSAEDSCGGLYYHDNNLLSGSLEALIQHLVPNVDYYPDRTYIFTFLLSSRLFMHPYELMAKVCHLCVEHQRLSDPDSDKNQMRKIAPKILQLLTEWTETFPYDFRDERMMRNLKDLAHRIASGEEQTYRKNVQQMMQCLIRKLAALSQYEEVLAKISSTSTDRLTVLKTKPQSIQRDIITVCNDPYTLAQQLTHIELERLNYIGPEEFVQAFVQKDPLDNDKSCYSERKKTRNLEAYVEWFNRLSYLVATEICMPVKKKHRARMIEYFIDVARECFNIGNFNSLMAIISGMNMSPVSRLKKTWAKVKTAKFDILEHQMDPSSNFYNYRTALRGAAQRSLTAHSSREKIVIPFFSLLIKDIYFLNEGCANRLPNGHVNFEKFWELAKQVSEFMTWKQVECPFERDRKILQYLLTVPVFSEDALYLASYESEGPENHIEKDRWKSLRSSLLGRV

SEQ ID NO: 2449 - protein, 647 aa, Homo sapiens
MTVGRPEGAPGGAEGSRQIFPPESFADTEAGEELSGDGLVLPRASKLDEFLSPEEEMDSTSDSTGSIYQNLQELKQKGRWCLLESLFQSDPESDENLSEDEEDLESFFQDKDRGMVQVQCPQALRCGSTRRCSSLNNLPSNIPRPQTQPPSGSRPPSQHRSVSSWASSITVPRPFRMTLREARKKAEWLGSPASFEQERQRAQRQGEEEAECHRQFRAQPVPAHVYLPLYQEIMERSEARRQAGIQKRKELLLSSLKPFSFLEKEEQLKEAARQRDLAATAEAKISKQKATRRIPKSILEPALGDKLQEAELFRKIRIQMRALDMLQMASSPIASSSNRANPQPRTATRTQQEKLGFLHTNFRFQPRVNPVVPDYEGLYKAFQRRAAKRRETQEATRNKPFLLRTANLRHPQRPCDAATTGRRQDSPQPPATPLPRSRSLSGLASLSANTLPVHITDATRKRESAVRSALEKKNKADESIQWLEIHRKKSQAMSKSVTLRAKAMDPHKSLEEVFKAKLKENRNNDRKRAKEYKKELEEMKQRIQTRPYLFEQVAKDLAKKEAEQWYLDTLKQAGLEEDFVRNKGQGTRAVQEKETKIKDFPRFQETTKLSIRDPEQGLEGSLEQPASPRKVLEELSHQSPENLVSLA

SEQ ID NO: 2450 - protein, 334 aa, Homo sapiens
MRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 2451 - protein, 758 aa, Homo sapiens
MAPAMQPAEIQFAQRLASSEKGIRDRAVKKLRQYISVKTQRETGGFSQEELLKIWKGLFYCMWVQDEPLLQEELANTIAQLVHAVNNSAAQHLFIQTFWQTMNREWKGIDRLRLDKYYMLIRLVLRQSFEVLKRNGWEESRIKVFLDVLMKEVLCPESQSPNGVRFHFIDIYLDELSKVGGKELLADQNLKFIDPFCKIAAKTKDHTLVQTIARGVFEAIVDQSPFVPEETMEEQKTKVGDGDLSAEEIPENEVSLRRAVSKKKTALGKNHSRKDGLSDERGRDDCGTFEDTGPLLQFDYKAVADRLLEMTSRKNTPHFNRKRLSKLIKKFQDLSEGSSISQLSFAEDISADEDDQILSQGKHKKKGNKLLEKTNLEKEKGSRVFCVEEEDSESSLQKRRRKKKKKHHLQPENPGPGGAAPSLEQNRGREPEASGLKALKARVAEPGAEATSSTGEESGSEHPPAVPMHNKRKRPRKKSPRAHREMLESAVLPPEDMSQSGPSGSHPQGPRGSPTGGAQLLKRKRKLGVVPVNGSGLSTPAWPPLQQEGPPTGPAEGANSHTTLPQRRRLQKKKAGPGSLELCGLPSQKTASLKKRKKMRVMSNLVEHNGVLESEAGQPQALGSSGTCSSLKKQKLRAESDFVKFDTPFLPKPLFFRRAKSSTATHPPGPAVQLNKTPSSSKKVTFGLNRNMTAEFKKTDKSILVSPTGPSRVAFDPEQKPLHGVLKTPTSSPASSPLVAKKPLTTTPRRRPRAMDFF

SEQ ID NO: 2452 - protein, 112 aa, Homo sapiens
MPPHQQPRGLPGAAERGTHIRNKSLESGGRNRETTQALRPGAVLWPQAERKSPARGRVPGSLELRLGNETGDRCREAGVSQDPRGCAAGTRGAPEHRLGVADSGTRRRTRIL

SEQ ID NO: 2453 - protein, 224 aa, Homo sapiens [sequence omitted]

SEQ ID NO: 2454 - protein, 340 aa, Homo sapiens
MAKWLRDYLSFGGRRPPPQPPTPDYTESDILRAYRAQKNLDFEDPYEDAESRLEPDPAGPGDSKNPGDAKYGSPKHRLIKVEAADMARAKALLGGPGEELEADTEYLDPFDAQPHPAPPDDGYMEPYDAQWVMSELPGRGVQLYDTPYEEQDPETADGPPSGQKPRQSRMPQEDERPADEYDQPWEWKKDHISRAFAVQFDSPEWEGTPGSAKELRRPPPRSPQPAERVDPALPLEKQPWFHGPLNRADAESLLSLCKEGSYLVRLSETNPQDCSLSLRSSQGFLHLKFARTRENQVVLGQHSGPFPSVPELVLHYSSRPLPVQGAEHLALLYPVVTQTP

SEQ ID NO: 2455 - protein, 155 aa, Homo sapiens
MPVSYSSVTTRYYHRAGAEEGKDRIIFVTKEDHETPSSAELVADDPNDPYEEHGLILPNGNINWNCPCLGGMASGPCGEQFKSAFSCFHYSTEEIKGSDCVDQFRAMQECMQKYPDLYPQEDEDEEEEREKKPAEQAEETAPIEATATKEEEGSS

SEQ ID NO: 2456 - protein, 346 aa, Homo sapiens
MDSLAAPQDRLVEQLLSPRTQAQRRLKDIDKQYVGFATLPNQVHRKSVKKGFDFTLMVAGESGLGKSTLVHSLFLTDLYKDRKLLSAEERISQTVEILKHTVDIEEKGVKLKLTIVDTPGFGDAVNNTECWKPITDYVDQQFEQYFRDESGLNRKNIQDNRVHCCLYFISPFGHGLRPVDVGFMKALHEKVNIVPLIAKADCLVPSEIRKLKERIREEIDKFGIHVYQFPECDSDEDEDFKQQDRELKESAPFAVIGSNTVVEAKGQRVRGRLYPWGIVEGALRLREAAQHAHPHAYARPQGRDVRRALRELPRALHPADDQQTDPGQPHGEPHPDPAAAHPGRRD

SEQ ID NO: 2457 - protein, 163 aa, Homo sapiens [sequence omitted]

SEQ ID NO: 2458 - protein, 376 aa, Homo sapiens [sequence omitted]

SEQ ID NO: 2459 - protein, 163 aa, Homo sapiens
MAQRTYGPECQRNLKGESPGSPGRDGYGDFFTPGTAGPGLAVSSLRLWASPDTRPEGVGVAAAASLSSGCHWLASAPHPAPGAAAATTTAAGELCAKGACAAYVELTEANYGAPDGTSTMSGPAHARSAGRFRTRCTGGRKVRSCLISLRAETAVAAQNRSVG

SEQ ID NO: 2460 - protein, 191 aa, Homo sapiens
MTPSSLGTITAIFTTSWDPSIRCSRIGLRVRGLGWISAAIGGGGAPGAPPPTAPRGRAEETAGARTQVETETLAGRSGTPETGEHSLAASLGNDSALPASGTKTATTWDASRRHYKRRGRSAGGRSLCGRGLPQGVAAGGREGGSTSGRVVKEEGKPGAGGGDLVSQCACVSPASPFSPLPSATPRALQHH

SEQ ID NO: 2461 - protein, 491 aa, Homo sapiens [sequence omitted]

SEQ ID NO: 2462 - protein, 342 aa, Homo sapiens
MPFLLGLRQDKEACVGTNNQSYICDTGHCCGQSQCCNYYYELWWFWLVWTIIIILSCCCVCHHRRAKHRLQAQQRQHEINLIAYREAHNYSALPFYFRFLPNYLLPPYEEVVNRPPTPPPPYSAFQLQQQQLLPPQCGPAGGSPPGIDPTRGSQGAQSSPLSEPSRSSTRPPSIADPDPSDLPVDRAATKAPGMEPSGSVAGLGELDPGAFLDKDAECREELLKDDSSEHGAPDSKEKTPGRHRRFTGDSGIEVCVCNRGHHDDDLKEFNTLIDDALDGPLDFCDSCHVRPPGDEEEGLCQPSEEQAREPGHPHLPRPPSCLLLNTINEQDSPNSQSSSSPS

SEQ ID NO: 2463 - protein, 436 aa, Homo sapiens
MSDSTWMSADPHLASSLSPSQDERMRSPQNLHSQEDDDSSSESGSGNGSSTLNPSTSSSTQGDPAFPEMNGNGAVAPMDFTTAAEDQPINLCDKLPPATALGTASYPSDGCGADGLRSRVKYGVKTTPESPPYSSGSYDSIKTEVSGCPEDLTVGRAPTADDDDDDHDDHEDNDKMNDSEGMDPERLKAFNMFVRLFVDENLDRMVPISKQPKEEIQAIIESCSRQFPEFQERARKRIRTYLKSCRRMKKNGMEMTRPTPPHLTSAMAENILAAACESETRKAAKRMRLEIYQSSQDEPIALDKQHSRDSAAITHSTYSLPASSYSQDPVYANGGLNYSYRGYGALSSNLQPPASLQTGNHSNGPTDLSMKGGASTTSTTPTPTPSSTSTSRPVPTAQLSPTEISAVRQLIAGYRESAAFLLRSADELENLILQQN

SEQ ID NO: 2464 - protein, 784 aa, Homo sapiens
MMDSENKPENDEDEKINKEAQDLTKLSSHNEDGGPVSDVIASFPENSMGKRGFSESSNSDSVVIGEDRNKHASKRRKLDEAEPLKSGKQGICRLETSESSVTEGGIALDETGKETFLSDCTVGGTCLPNALSPSCNFSTIDVVSLKTDTEKTSAQEMVSLDLERESPFPPKEISVSCTIGNVDTVLKCSICGHLFSSCSDLEKHAESHMQQPKEHTCCHCSHKAESSSALHMHIKQAHGPQKVFSCDLCGFQCSEENLLNAHYLGKTHLRRQNLAARGGFVQILTKQPFPKKSRTMATKNVHSKPRTSKSIAKNSDSKGLRNVGSTFKDFRGSISKQSGSSSELLVEMMPSRNTLSQEVEIVEEHVTSLGLAQNPENQSRKLDTLVTSEGLLEKLESTKNTLQAAHGNSVTSRPRPERNILVLGNSFRRRSSTFTLKGQAKKRFNLLGIKRGTSETQRMYMKHLRTQMKTHDAESVLKHLEACSSVQRVCVTTSETQEAEQGQGSARPPDSGLHSLTVKPASGSQTLCACTDCGQVATNRTDLEIHVKRCHAREMKFYCRTCDFSSMSRRDLDEHLHSNQHQQTASVLSCQCCSFISLDEINLRDHMKEKHNMHFLCTPCNLFFLSEKDVEEHKATEKHINSLVQPKTLQSSNSDLVLQTLPLSTLESENAKESMDDSGKASQEEPLKSRVSHGNEVRHSSKPQFQCKKCFYKTRSSTVLTRHIKLRHGQDYHFLCKACNLYSLSKEGMEKHIKRSKHLENAKKNNIGLSFEECIERVCIGAND

SEQ ID NO: 2465 - protein, 235 aa, Homo sapiens [sequence omitted]

SEQ ID NO: 2466 - protein, 707 aa, Homo sapiens [sequence omitted]

SEQ ID NO: 2467 - protein, 468 aa, Homo sapiens [sequence omitted]

SEQ ID NO: 2468 - protein, 453 aa, Homo sapiens [sequence omitted]

SEQ ID NO: 2469 - protein, 191 aa, Homo sapiens
MRLLALAAAALLARAPAPEVCAALNVTVSPGPVVDYLEGENATLLCHVSQKRRKDSLLAVRWFFAHSFDSQEALMVKMTKLRVVQYYGNFSRSAKRRRLRLLEEQRGALYRLSVLTLQPSDQGHYVCRVQEISRHRNKWTAWSNGSSATEMRGVSSHPVERGAFLGISLVILPHSLPFTADLTMASFLQSS

SEQ ID NO: 2470 - protein, 846 aa, Homo sapiens
MELSDSDRPVSFGSTSSSASSRDSHGSFGSRMTLVSNSHMGLFNQDKEVGAIKLELIPARPFSSSELQRDNPATGQQNADEGSERPPRAQWRVDSNGAPKTIADSATSPKLLYVDRVVQEILETERTYVQDLKSIVEDYLDCIRDQTKLPLGTEERSALFGNIQDIYHFNSELLQDLENCENDPVAIAECFVSKSEEFHIYTQYCTNYPRSVAVLTECMRNKILAKFFRERQETLKHSLPLGSYLLKPVQRILKYHLLLHEIENHLDKDTEGYDVVLDAIDTMQRVAWHINDMKRKHEHAVRLQEIQSLLTNWKGPDLTSYGELVLEETFRIQRAKNERTLFLFDKLLLITKKRDDTFTYKAHILCGNLMLVEVIPKEPLSFSVFHYKNPKLQHTVQAKSQQDKRLWVLHLKRLILENHAAKIPAKAKQAILEMDAIHHPGFCYSPEGGTKALFGSKEGSAPYQLRRKSEPSSRSHKVLKTSETAQDIQKVSREEGSPQLSSARPSPAQRNSQPSSSTMISVLRAGGALRNIWTDHQIRQALFPSRRSPQENEDDEDDYQMFVPSFSSSDLNSTRLCEDSTSSRPCSWHMGQMESTETSSSGHRIVRRASSAGESNTCPPEIGTSDRTRELQNSPKTEGQEEMTPFGSSIELTIDDIDHVYDNISYEDLKLMVAKREEAESTPSKSARDSVRPKSTPELAFTKRQAGHSKGSLYAQTDGTLSGGEASSQSTHELQAVEENIYDTIGLPDPPSLGFKCSSLKRAKRSTFLGLEADFVCCDSLRPFVSQDSLQLSEDEAPYHQATPDHGYLSLLYDSPSGNLSMPHKPVSDKLSEEVDEIWNDLENYI

SEQ ID NO: 2471 - protein, 240 aa, Homo sapiens
MRENFAIYPSDKGLISRIYNELGQIYQKKTNNPIDKWVKDMNSHFSKEDIYVAKRHMKKCSSSVAIREMQIKTTMRYHLTPVRMAIIKKSGNNRCWRGCGEIGTLLYCWWDCKLVQTLWKSVWRFLRDLGLEIPFDPAIPLLGIYPEYYKSCCYKDTCTRMFIAALFTIAKTWNKPKCPTVIDWIKKMWHIYTMEYYAAIKNDEFMSFVGTWMMLETIILSKLSQGQKTKHHMFSLTGGN

SEQ ID NO: 2472 - protein, 648 aa, Homo sapiens
MELVTFRDVAIEFSPEEWKCLDPARQNLYRDVMLENYRNLVSLGFVISNPDLVTCLEQIKEPCNLKIHETAAKPPAICSPFSQDLSPVQGIEDSFHKLILKRYEKCGHENLQLRKGCKRVNECKVQKGVNNGVYQCLSTTQSKIFQCNTCVKVFSKFSNSNKHKIRHTGEKPFKCTECGRSFYMSHLTQHTGIHAGEKPYKCEKCGKAFNRSTSLSKHKRIHTGEKPYTCEECGKAFRRSTVLNEHKKIHTGEKPYKCEECGKAFTRSTTLNEHKKIHTGEKPYKCKECGKAFRWSTSLNEHKNIHTGEKPYKCKECGKAFRQSRSLNEHKNIHTGEKPYTCEKCGKAFNQSSSLIIHRSIHSEQKLYKCEECGKAFTWSSSLNKHKRIHTGEKPYTCEECGKAFYRSSHLAKHKRIHTGEKPYTCEECGKAFNQSSTLILHKRIHSGQKPYKCEECGKAFTRSTTLNEHKKIHTGEKPYKCEECGKAFIWSASLNEHKNIHTGEKPYKCKECGKAFNQSSGLIIHRSIHSEQKLYKCEECGKAFTRSTALNEHKKIHSGEKPYKCKECGKAYNLSSTLTKHKRIHTGEKPFTCEECGKAFNWSSSLTKHKIIHTGEKSYKCEECGKAFNRPSTLTVHKRIHTGKEHS

SEQ ID NO: 2473 - protein, 357 aa, Homo sapiens
MSAFEKPQIIAHIQKGFNYTVFDCKWVPCSAKFVTMGNFARGTGVIQLYEIQHGDLKLLREIEKAKPIKCGTFGATSLQQRYLATGDFGGNLHIWNLEAPEMPVYSVKGHKEIINAIDGIGGLGIGEGAPEIVTGSRDGTVKVWDPRQKDDPVANMEPVQGENKRDCWTVAFGNAYNQEERVVCAGYDNGDIKLFDLRNMALRWETNIKNGVCSLEFDRKDISMNKLVATSLEGKFHVFDMRTQHPTKGFASVSEKAHKSTVWQVRHLPQNRELFLTAGGAGGLHLWKYEYPIQRSKKDSEGIEMGVAGSVSLLQNVTLSTQPISSLDWSPDKRGLCVCSSFDQTVRVLIVTKLNKI

SEQ ID NO: 2474 - protein, 115 aa, Homo sapiens [sequence omitted]

SEQ ID NO: 2475 - protein, 303 aa, Homo sapiens
MAEMDERFQQILSWQQMDQNKAISQILQESAMQKAAFEALQVKKDLMHRQIRSQIKLIETELLQLTQLELKRKSLDTESLQEMISEQRWALSSLLQQLLKEKQQREEELREILTELEAKSETRQENYWLIQYQRLLNQKPLSLKLQEEGMERQLVALLEELSAEHYLPIFAHHRLSLDLLSQMSPGDLAKVGVSEAGLQHEILRRVQELLDAARIQPELKPPMGEVVTPTAPQEPPESVRPSAPPAELEVQASECVVCLEREAQMIFLNCGHVCCCQQCCQPLRTCPLCRQDIAQRLRIYHSS

SEQ ID NO: 2476 - protein, 145 aa, Homo sapiens
MSSLFFTLLIVPSTSLTCVLHLMSPRTTPHRTVRHVGWREQKSCQRSRHEHPSAWWAGFVCLSFCERNTDKQLCSARHTDVSLPPVPKAPAAVSFAGRAWSRGSEGLVFGPPSFLSSPAQLLRSIMAIILVPDCPKVPSWLWGTL

SEQ ID NO: 2477 - protein, 455 aa, Homo sapiens
MSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNERLTIPSSCPRSFAELLHQCWEADAKKRPSFKQIISILESMSNDTSLPDKCNSFLHNKAEWRCEIEATLERLKKLERDLSFKEQELKERERRLKMWEQKLTEQSNTPLLLPLAARMSEESYFESKTEESNSAEMSCQITATSNGEGHGMNPSLQAMMLMGFGDIFSMNKAGAVMHSGMQINMQAKQNSSKTTSKRRGKKVNMALGFSDFDLSEGDDDDDDDGEEEDNDMDNSE

SEQ ID NO: 2478 - protein, 118 aa, Homo sapiens [sequence omitted]

SEQ ID NO: 2479 - protein, 618 aa, Homo sapiens
MERAVEPWGPDLHRPEEREPQRGARTGLGSENVISQPNEFEHTPQEDDLGFKEEDLAPDHEVGNVSLKPEGIQNWDDLWVQREGLGKPQPRDRGPRLLGEPRWGQASSDRAAVCGECGKSFRQMSDLVKHQRTHTGEKPYKCGVCGKGFGDSSARIKHQRTHSGEKPYRARPPAQGPPKIPRSRIPAGERPTICGECGKSFRLSSDLVKHQRTHTGEKPYKCGICGKGFGDSSARIKHQRTHRGEQPPRPVVPRRQPSRAATAATQGPKAQDKPYICTDCGKRFVLSCSLLSHQRSHLGPKPFGCDVCGKEFARGSDLVKHLRVHTGEKPYLCPECGKGFADSSARVKHLRTHSGERPHACPECDRTFSLSSTLLRHRLTHMEPQDFSFPGYPLPALIPSPPPPPLGTSPPLTPRSPSHSGEPFGLPGLEPEPGGPQAGEPPPPLAGDKPHKCPECGKGFRRSSDLVKHHRVHTGEKPYLCPECGKGFADSSARVKHLRTHRGERARPPPPSTLLRPHNPPGPVPMAPRPRVRAQPSGPSQPHVCGFCGKEFPRSSDLVKHRRTHTGEKPYKCAECGKGFGDSSARIKHQRGHLVLTPFGIGDGRARPLKQEAATGLE

SEQ ID NO: 2480 - protein, 567 aa, Homo sapiens
MVVSTFTDMDTFPNNFPPGGDSGLTGSQSEFQKMLIDERLRCEHHKANYQTLKAEHTRLQNEHVKLQNELKHLFNEKQTQQEKLQLLLEELRGELVEKTKDLEEMKLQILTPQKLELLRAQIQQELETPMRERFRNLDEEVEKYRAVYNKLRYEHTFLKSEFEHQKEEYARILDEGKIKYESEIARLEEDKEELRNQLLNVDLTKDSKRVEQLAREKVYLCQKLKGLEAEVAELKAEKENSEAQVENAQRIQVRQLAEMQATVRSLEAEKQSANLRAERLEKELQSSSEQNTFLINKLHKAEREINTLSSKVKELKHSNKLEITDIKLETARAKSELERERNKIQSELDGLQSDNEILKAAVEHHKVLLVEKDRELIRKVQAAKEEGYQKLVVLQDEKLELENRLADLEKMKVEHDVWRQSEKDQYEEKLRASQMAEEITRKELQSVRLKLQQQIVTIENAEKEKNENSDLKQQISSLQIQVTSLAQSENDLLNSNQMLKEMVERLKQECRNFRSQAEKAQLEAEKTLEEKQIQWLEEKHKLHERITDREEKYNQAKEKLQRAAIAQ

SEQ ID NO: 2481 - protein, 364 aa, Homo sapiens
MPPPPPLLLLTVLVVAAARPGCEFERNPAGECHRPPAADSATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSMNPDGYEVAAAEGAGYNGWTSGRQNAQNLDLNRNFPDLTSEYYRLAETRGARSDHIPIPQHYWWGKVPRRQRQS

SEQ ID NO: 2482 - protein, 149 aa, Homo sapiens [sequence omitted]

SEQ ID NO: 2483 - protein, 521 aa, Homo sapiens
MFTSEKGVVEEWLSEFKTLPETSLPNYATNLKDKSSLVSSLYKVIQEPQSELLEPVCHQLFEFYRSGEEQLLQFTLQFLPELIWCYLAVSASRNVHSSGCIEALLLGVYNLEIVDKQGHTKVLSFTIPSLSKPSVYHEPSSIGSMALTESALSQHGLSKVVYSGPHPQREMLTAQNRFEVLTFLLLCYNAALTYMPSVSLQSLCQICSRICVCGYPRQHVRKYKGISSRIPVSSGFMVQMLTGIYFAFYNGEWDLAQKALDDIIYRAQLELYPEPLLVANAIKASLPHGPMKSNKEGTRCIQVEITPTSSRISRNAVTSMSIRGHRWKRHGNTELTGQEELMEISEVDEGFYSRAASSTSQSGLSNSSHNCSNKPSIGKNHRRSGGSKTGGKEKETTGESCKDHFARKQTQRAQSENLELLSLKRLTLTTSQSLPKPSSHGLAKTAATVFSKSFEQVSGVTVPHNPSSAVGCGAGTDANRFSACSLQEEKLIYVSERTELPMKHQSGQQRPPSISITLSTD

SEQ ID NO: 2484 - protein, 197 aa, Homo sapiens
MEHKDDDDDDVSFAKWMSSFWGHSWREEDQRGLRERHRLQATSHRKTSLPCPLPVLPRIPSSDCHPRRHSHEDQEFRCRSSDRLPRRHSHEDQEFRCRSHVRDYRKYSEDGSFKEPLESKGRSHSKIEKFSESFERQLCFRTKRSASLGPESRKERNERECLRMEIKSRKKVEEERSSRKEEHGEAHMAPLFEKGPE

SEQ ID NO: 2485 - protein, 220 aa, Homo sapiens
MVKISFQPAVAGIKGDKADKASASAPAPASATEILLTPARLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 2486 - protein, 230 aa, Homo sapiens
MSFKREGDDWSQLNVLKKRRVGDLLASYIPEDEALMLRDGRFACAICPHRPVLDTLAMLTAHRAGKKHLSSLQLFYGKKQPGKERKQNPKHQNELRREETKAEAPLLTQTRLITQSALHRAPHYNSCCRRKYRPEAPGPSVSLSPMPPSEVKLQSGKISREPEPAAGPQAEESATVSAPAPMSPTRRRALDHYLTLRSSGWIPDGRGRWVKDENVEFDSDEEEPPDLPLD

SEQ ID NO: 2487 - protein, 103 aa, Homo sapiens
MPPPQPMELLWLSSLSRTVEKGRWGPSPNSTASSAVCPQPRRAGKASGLLHLVLVTPGVCVQITTSLFGSLLRSRFPDGSITALSYQAAVFHSWWSQPGKLLS

SEQ ID NO: 2488 - protein, 182 aa, Homo sapiens
MWPPDPDPDPDPEPAGGSRPGPAVPGLRALLPARAFLCSLKGRLLLAESGLSFITFICYVASSASAFLTAPLLEFLLALYFLFADAMQLNDKWQGLCWPMMDFLRCVTAALIYFAISITAIAKYSDGASKAAGVFGFFATIVFATDFYLIFNDVAKFLKQGDSADETTAHKTEEENSDSDSD

SEQ ID NO: 2489 - protein, 218 aa, Homo sapiens
MALPPGPAALRHTLLLLPALLSSVKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 2490 - protein, 209 aa, Homo sapiens
MASRGLSLFPESCPDFCCGTCDDQYCCSDVLKKFVWSEERCAVPEASVPASVEPVEQLGSALRFRPGYNDPMSGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 2491 - protein, 591 aa, Homo sapiens
MASKCSSERKSRTSLTLNQKLEMIKLSEEGMSKAEIGRRLGLLRQTVSQVVNAKEKFLKEVKSATPMNTRMIRKRNSLIADMEKVLVVWIEDQTSRNIPLSQSLIQNKALTLFNSMKAERGVEAAEEKFEASRGWFMRFKERSHFHNIKAQGEAASADVEAAASYPEALAKIIDEGGYTKQQIFNVDETAFYWKKMPSRTFIAREEKSVPGFKASKDRLTLLLGANAAGDFKLKPMLIYHSENPRALKNYTKSTLPVLYKWNSKARMTAHLFTAWFTEYFKPTVETYCSEKKIPFKILLLIDNAPSHPRALMEIYEEINVIFMPANTTSILQPMDQGVISTFKSYYLRNTFHKALAAMDSDVSDGSGQSKLKTFWKGFTILDAIKNIRDSWEEVKLSTLTGVWKKLIPTLIDDYEGFKTSVEEVSADVVEIAKELELEVEPEDVTELLQSHDKTLTDEELFLMDAQRKWFLEMESTPGEDAVNIVEMTTKDLEYYINLVDKAAAGFERIDSNFERSSTVGKMLSNSIACYREIFHERKSQLMRKASPMSYFRKLPQPPQPSAATTLTSQQPSTSRQDPPPAKRVRLTEGSD

SEQ ID NO: 2492 - protein, 396 aa, Homo sapiens
MYLYNVEHTCGTTAPHYQLLKQGESFAVHTCKSKSTRNPLLKWTVGEGALNEFAFSPDGKFLACVSQDGFLRVFNFDSVELHGTMKSYFGGLLCVCWSPDGKYIVTGGEDDLVTVWSFVDCRVIARGHGHKSWVSVVAFDPYTTSVEEGDPMEFSGSDEDFQDLLHFGRDRANSTQSRLSKRNSTDSRPVSVTYRFGSVGQDTQLCLWDLTEDILFPHQPLSRARTHTNVMNATSPPAGSNGNSVTTPGNSVPPPLPRSNSLPHSAVSNAGSKSSVMDGAIASGVSKFATLSLHDRKERHHEKDHKRNHSMGHISSKSSDKLNLVTKTKTDPAKTLGTPLCPRMEDVPLLEPLICKKIAHERLTVLIFLEDCIVTACQEGFICTWGRPGKVVSFNP

SEQ ID NO: 2493 - protein, 512 aa, Homo sapiens
MTSDGTLFIKNAAPKDAGIYGCLASNSAGTDKQNSTLRYIEAPKLMVVQSELLVALGDITVMECKTSGIPPPQVKWFKGDLELRPSTFLIIDPLLGLLKIQETQDLDAGDYTCVAINEAGRATGKITLDVGSPPVFIQEPADVSMEIGSNVTLPCYVQGYPEPTIKWRRLDNMPIFSRPFSVSSISQLRTGALFILNLWASDKGTYICEAENQFGKIQSETTVTVTGLVAPLIGISPSVANVIEGQQLTLPCTLLAGNPIPERRWIKNSAMLLQNPYITVRSDGSLHIERVQLQDGGEYTCVASNVAGTNNKTTSVVVHVLPTIQHGQQILSTIEGIPVTLPCKASGNPKPSVIWSKKGELISTSSAKFSAGADGSLYVVSPGGEESGEYVCTATNTAGYAKRKVQLTVYVRPRVFGDQRGLSQDKPVEISVLAGEEVTLPCEVKSLPPPIITWAKETQLISPFSPRHTFLPSGSMKITETRTSDSGMYLCVATNIAGNVTQAVKLNVHGES

SEQ ID NO: 2494 - protein, 340 aa, Homo sapiens
MGLKCMPSHHHRTGLFTALERQRSFIHSRSQAVRVHAEHPHAHSWWLSLMYLTSHAFPQSSSTVPLHGLGSPKLKCECQSASFKRGLPHGHPLPLCPCFDRSIHLAIHPWGSAMATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGTTHRGTDDCGHEGSVSGLRPGPGRGGYGALASGVHGLPLLRGHHRLRALDILPQLPTSCPRPPTELPVAAEGGPEPGTGPAVPCAVHLRGPLPLPVLHPPQR

SEQ ID NO: 2495 - protein, 223 aa, Homo sapiens
MWKPSPSSSPASWSCTALRAPQSCLRAATVRPVTLQARADSPTVPEPVHRPQDPWHIPGVPEPVHRPQDPWHIPGVPEPVHRPQDPWHIPGVPEPVHRPQDPWHIPGVPEPVHRPQDPWPWLQLVPPAELAYCLLMLLLAHCMKQQARPGHPDFLHREAWACLSAAGGLASPGLLLWATARPRASGEAGPGRALVGADAACCPRHSVLSLVDIPSGQVLPQGQ

SEQ ID NO: 2496 - protein, 612 aa, Homo sapiens
MATAATIPSVATATAAALGEVEDEGLLASLFRDRFPEAQWRERPDVGRYLRELSGSGLERLRREPERLAEERAQLLQQTRDLAFANYKTFIRGAECTERIHRLFGDVEASLGRLLDRLPSFQQSCRNFVKEAEEISSNRRMNSLTLNRHTEILEILEIPQLMDTCVRNSYYEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEASRVHLFDIITQYRAIFSDEDPLLPPAMGEHTVNESAIFHGWVLQKVSQFLQVLETDLYRGIGGHLDSLLGRCMYFGLSFSRVGADFRGQLAPVFQRVAISTFQKAIQETVEKFQEEMNSYMLISAPAILGTSNMPAAVPATQPGTLQPPMVLLDFPPLACFLNNILVAFNDLRLCCPVALAQDVTGALEDALAKVTKIILAFHRAEEAAFSSGEQELFVQFCTVFLEDLVPYLNRCLQVLFPPAQIAQTLGIPPTQLSKYGNLGHVNIGAIQEPLAFILPKRETLFTLDDQALGPELTAPAPEPPAEEPRLEPAGPACPEGGRAETQAEPPSVGP

SEQ ID NO: 2497 - protein, 251 aa, Homo sapiens
MHNAAREMVFVAEQGVMADKNRLDPTWQEMLNHATCKVNEAEEERLRGEREHQRVTRLCQQAEARVQALQKTLRRAIGKSRPYFELKAQFSQILEEHKAKVTELEQQVAQAKTRYSVALRNLEQISEQIHARRRGGLPPHPLGPRRSSPVGAEAGPEDMEDGDSGIEGAEGAGLEEGSSLGPGPAPDTDTLSLLSLRTVASDLQKCDSVEHLRGLSDHVSLDGQELGTRSGGRRGSDGGARGGRHQRSVSL

SEQ ID NO: 2498 - protein, 173 aa, Homo sapiens
MDAAAAALPAAALPAAHPVVLQPQCQVLLQDGLLQWLDPLPGCARHPCVCRARTQRREHEVRVWVFPEGTRNHNGSMLPFKRGAFHLAVQAQVPIVPIVMSSYQDFYCKKERRFTSGQCQVRVLPPVPTEGLTPDDVPALADRVRHSMLTVFREISTDGRGGGDYLKKPGGGG

SEQ ID NO: 2499 - protein, 120 aa, Homo sapiens
MAILVASLIRNRRGAKEASCVGPQSESGNDFKLKRRRRAEFPFLNGLISELGWSLTGSAGEGRVGTHCPFALPPPRAEADSAGARVAELGERKCPSQSEVAGPAPRLRERRSSWVRLCLL

SEQ ID NO: 2500 - protein, 554 aa, Homo sapiens
MASRAVVRARRCPQCPQVRAAAAAPAWAALPLSRSLPPCSNSSSFSMPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILCSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVALAAVLVPVLVMVLTTLILILVCAWHW

SEQ ID NO: 2501 - protein, 106 aa, Homo sapiens
MMAWKKEPQISSIHLKVNLSKTELLMIFPLKSTLPTAYSSQIAGVQWHDHISLQLLPPGLKQSSYLSLLSSWDYSLPLLPSLDCTAMISARCNLPASSSGDSPASA

SEQ ID NO: 2502 - protein, 111 aa, Homo sapiens
MLGMYVPDRFSLKSSRVQDGMGLYTARRVRKGEKFGPFAGEKRMPEDLDENMDYRLMWEVRGSKGEVLYILDATNPRHSNWLRFVHEAPSQEQKNLAAIQDKNLGPAEWRG

SEQ ID NO: 2503 - protein, 454 aa, Homo sapiens
MVFCLSSEEPRRPLRSDMVHFQASEVQQLLHNKFVVILGDSIQRAVYKDLVLLLQKDSLLTAAQLKAKGELSFEQDQLVAGGQLGELHNGTQYREVRQFCSGSGHHLVRFYFLTRVYSEYLEDVLEELTYGPAPDLVIINSCLWDLSRYGRCSMESYRENLERVFVRMDQVLPDSCLLVWNMAMPLGERITGGFLLPELQPLAGSLRRDVVEGNFYSATLAGDHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHEFFNYNPVEDFSMPPHLGCGPGVNFVPGPLPPPIPGPNPHGQHWGPVVHRGMPRYVPNSPYHVRRMGGPCRQRLRHSERLIHTYKLDRRPPAHSGTWPG

SEQ ID NO: 2504 - protein, 167 aa, Homo sapiens
MNDQIRELQTIIRDKTASRGDFMFSADRLIRLVVEEGLNQLPYKECMVTTPTGYKYEGVKFEKGNCGVSIMRSGEAMEQGLRDCCRSIRIGKILIQSDEETQRAKVYYAKFPPDIYRRKVLLMYPILSTGNTVIEAVKVLIEHGVQPSVIILLSLFSTPHGEFSMRQ

SEQ ID NO: 2505 - protein, 147 aa, Homo sapiens [sequence omitted]

SEQ ID NO: 2506 - protein, 224 aa, Homo sapiens
MAAPSEVAAIAPGEGDGGGGGFGSWLDGRLEALGVDRAVYGAYILGILQEEEEEEKLDALQGILSAFLEEDSLLNICKEIVERWSETQNVVTKVKKEDEVQAIATLIEKQAQIVVKPRMVSEEEKQRKAALLAQYADVTDEEDEADEKDDSGATTMNIGSDKLLFRNTNVEDVFNARKLERDSLRDESQRKKEQDKLQRERDKLAKQERKEKEKKRTQRGERKR

SEQ ID NO: 2507 - protein, 157 aa, Homo sapiens
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLASESAPLPPCHGAVPPHLSHPEAPTIHAASCYS

SEQ ID NO: 2508 - protein, 517 aa, Homo sapiens
MPPPGKVPRKENLWLQCEWGSCSFVCSTMEKFFEHVTQHLQQHLHGSGEEEEEEEEDDPLEEEFSCLWQECGFCSLDSSADLIRHVYFHCYHTKLKQWGLQALQSQADLGPCILDFQSRNVIPDIPDHFLCLWEHCENSFDNPEWFYRHVEAHSLCCEYEAVGKDNPVVLCGWKGCTCTFKDRSKLREHLRSHTQEKVVACPTCGGMFANNTKFLDHIRRQTSLDQQHFQCSHCSKRFATERLLRDHMRNHVNHYKCPLCDMTCPLPSSLRNHMRFRHSEDRPFKCDCCDYSCKNLIDLQKHLDTHSEEPAYRCDFENCTFSARSLCSIKSHYRKVHEGDSEPRYKCHVCDKCFTRGNNLTVHLRKKHQFKWPSGHPRFRYKEHEDGYMRLQLVRYESVELTQQLLRQPQEGSGLGTSLNESSLQGIILETVPGEPGRKEEEEEGKGSEGTALSASQDNPSSVIHVVNQTNAQGQQEIVYYVLSEAPGEPPPAPEPPSGGIMEKLQGIAEEPEIQMV

SEQ ID NO: 2509 - protein, 595 aa, Homo sapiens [sequence omitted]

SEQ ID NO: 2510 - protein, 241 aa, Homo sapiens [sequence omitted]

SEQ ID NO: 2511 - protein, 273 aa, Homo sapiens
MGQKLSGSLKSVEVREPALRPAKRELRGAEPGRPARLDQLLDMPAAGLAVQLRHAWNPEDRSLNVFVKDDDRLTFHRHPVAQSTDGIRGKVGHARGLHAWQINWPARQRGTHAVVGVATARAPLHSVGYTALVGSDAESWGWDLGRSRLYHDGKNQPGVAYPAFLGPDEAFALPDSLLVVLDMDEGTLSFIVDGQYLGVAFRGLKGKKLYPVVSAVWGHCEVTMRYINGLDPEPLPLMDLCRRSIRSALGRQRLQDISSLPLPQSLKNYLQYQ

SEQ ID NO: 2512 - protein, 781 aa, Homo sapiens
MEAVSRVFPALAGQAPEEQGEIIKVKVKEEDHTWDQESALRRNLSYTRELSRQRFRQFCYQETPGPREALSQLRELCRQWLNPEIHTKEQILELLVLEQFLTILPEELQSWVREHNPESGEEVVTLLEDLERELDEPRQQVSQGTYGQEVSMEEMIPLDSAKESLGTQLQSMEDRMECESPEPHPLQDNGSFLWFSMMSQSMGGDNLSSLDTNEAEIEPENMREKFFRSLARLLENKSNNTKIFSKAKYCQLIKEVKEAKAKAKKESVDYRRLARFDVILVQGNEKLIEAVNGETDKIRYYLHSEDLFDILHNTHLSIGHGGRTRMEKELQAKYKNITKEVIMLYLTLCKPCQQKNSKLKKVLTSKSIKEVSSRCQVDLIDMQLNPDGEYRFILHYQDLCTKLTFLRSLKSKRPTEVAHALLDIFTIIGAPSVLQSDNGREFSSQVVSELSNIWPELKIVHGKSQTCQSQSSAEQTEDIRKRIFSWMQTNNSSHWTEFLWFIQMSQNQPYHRSMQQTPCESAFSSEAKLGLSHSQLTEELVASLHTENELDQADKELENTLRAQYEENIETGTDSSDIEENLSVTPKVAEKSPPESRLRFLSCVVCEKECTGVNSCISCDGNIHAICGVPSQHGTEGCGRQITCSLCYETSTMKRKHDEIQRSLPVKPSKMLKPSGTPFSPDKVGDWMAKQASLDFFVKKRHAFSEHSSSNKRNVNNRSYPEEGKTKRVHASFTRKYDPSYIEFGFVAVIDGEVLKPQCIICGDVLANEAMKPSKLKRHLY

SEQ ID NO: 2513 - protein, 606 aa, Homo sapiens
MLHTAISCWQPFLGLAVVLIFMGSTIGCPARCECSAQNKSVSCHRRRLIAIPEGIPIETKILDLSKNRLKSVNPEEFISYPLLEEIDLSDNIIANVEPGAFNNLFNLRSLRLKGNRLKLVPLGVFTGLSNLTKLDISENKIVILLDYMFQDLHNLKSLEVGDNDLVYISHRAFSGLLSLEQLTLEKCNLTAVPTEALSHLRSLISLHLKHLNINNMPVYAFKRLFHLKHLEIDYWPLLDMMPANSLYGLNLTSLSVTNTNLSTVPFLAFKHLVYLTHLNLSYNPISTIEAGMFSDLIRLQELHIVGAQLRTIEPHSFQGLRFLRVLNVSQNLLETLEENVFSSPRALEVLSINNNPLACDCRLLWILQRQPTLQFGGQQPMCAGPDTIRERSFKDFHSTALSFYFTCKKPKIREKKLQHLLVDEGQTVQLECSADGDPQPVISWVTPRRRFITTKSNGRATVLGDGTLEIRFAQDQDSGMYVCIASNAAGNDTFTASLTVKGFASDRFLYANRTPMYMTDSNDTISNGTNANTFSLDLKTILVSTAMGCFTFLGVVLFCFLLLFVWSRGKGKHKNSIDLEYVPRKNNGAVVEGEVAGPRRFNMKMI

SEQ ID NO: 2514 - protein, 337 aa, Homo sapiens
MRRGWKMALSGGLRCCRRVLSWVPVLVIVLVVLWSYYAYVFELCLVTVLSPAEKVIYLILYHAIFVFFTWTYWKSIFTLPQQPNQKFHLSYTDKERYENEERPEVQKQMLVDMAKKLPVYTRTGSGAVRFCDRCHLIKPDRCHHCSVCAMCVLKMDHHCPWVNNCIGFSNYKFFLQFLAYSVLYCLYIATTVFSYFIKYWRGELPSVRSKFHVLFLLFVACMFFVSLVILFGYHCWLVSRNKTTLEAFCTPVFTSGPEKNGFNLGFIKNIQQVFGDKKKFWLIPIGSSPGDGHSFPMRSMNESQNPLLANEETWEDNEDDNQDYPEGSSSLAVETET

SEQ ID NO: 2515 - protein, 121 aa, Homo sapiens
MHTPEVASPSPGDRCREKSSPRPQTRFPSWHRVGDGWRVSIGTARSGCCQVGPCQGSSPLSTLCLAVPAPRYSNMACTQQSGGTTMVTADAPRLCLVNVAEQNGRLDPEEGPLSWHLSLAT

SEQ ID NO: 2516 - protein, 266 aa, Homo sapiens
MEPGAGGRNTARAQRAGSPNTPPPREQERKLEQEKLSGVVKSVHRRLRKKYREVGDFDKIWREHCEDEETLCEYAVAMKNLADNHWAKTCEGEGRIEWCCSVCREYFQNGGKRKALEKDEKRAVLATKTTPALNMHESSQLEGHLTNLSFTNPEFITELLQASGKIRLLDVGSCFNPFLKFEEFLTVGIDIVPAVESVYKCDFLNLQLQQPLQLAQDATDAFLKQLKNPIDSLPGELFHVVVFSLLLSYFPSPYQRWIAARKPMNC

SEQ ID NO: 2517 - protein, 693 aa, Homo sapiens [sequence omitted]

SEQ ID NO: 2518 - protein, 393 aa, Homo sapiens [sequence omitted]

SEQ ID NO: 2519 - protein, 124 aa, Homo sapiens
MPPNVELVVHCLGLWPSHPAVEAEVEDEASQEGDFSHSSHASALYLFSKAQLRCAGWSCLAVILAFWLMVQSSSLADPLFLLCFRGNPGNALTARLSLHPCWLVLARLRGPPLFLARSYLTFDV

SEQ ID NO: 2520 - protein, 104 aa, Homo sapiens [sequence omitted]

SEQ ID NO: 2521 - protein, 322 aa, Homo sapiens [sequence omitted]

SEQ ID NO: 2522 - protein, 217 aa, Homo sapiens
MKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKDNFPFDPPFVRVVSPVLSGGYVLGGGAICMELLTKQGWSSAYSIESVIMQISATLVKGKARVQFGANKSQYSLTRAQQSYKSLVQIHEKNGWYTPPKEDG

SEQ ID NO: 2523 - protein, 406 aa, Homo sapiens
MLETYSHLLSVGYQVPEAEVVMLEQGKEPWALQGERPRQSCPGEKLWDHNQCRKILSYKQVSSQPQKMYPGEKAYECAKFEKIFTQKSQLKVHLKVLAGEKLYVCIECGKAFVQKPEFIIHQKTHMREKPFKCNECGKSFFQVSSLFRHQRIHTGEKLYECSQCGKGFSYNSDLSIHEKIHTGERHHECTDCGKAFTQKSTLKMHQKIHTGERSYICIECGQAFIQKTHLIAHRRIHTGEKPYECSNCGKSFISKSQLQVHQRVHTRVKPYICTEYGKVFSNNSNLVTHKKVQSREKSSICTECGKAFTYRSELITHHRIHTGEKPYECSDCGKSFTKKSQLQVHQRIHTGEKPYVCAECGKAFTDRSNLNKHQTTHTGDKPYKCGICGKGFVQKSVFSVHQSSHA

SEQ ID NO: 2524 - protein, 564 aa, Homo sapiens
MLGGTDCRTFLTSHINLKKTLCDVILMVQERKIPAHRVVLAAASHFFNLMFTTNMLESKSFEVELKDAEPDIIEQLVEFAYTARISVNSNNVQSLLDAANQYQIEPVKKMCVDFLREQVDASNCLGISVLAECLDCPELKATADDFIHQHFTEVYKTDEFLQLDVKRVTHLLNQDTLTVRAEDQVYDAAVRWLKYDEPNRQPFMVDILAKVRFPLISKNFLSKTVQAEPLIQDNPECLKMVISGMRYHLLSPEDREELVDGTRPRRKKHDYRIALFGGSQPQSCRYFNPKDYSWTDIRCPFEKRRDAACVFWDNVVYILGGSQLFPIKRMDCYNVVKDSWYSKLGPPTPRDSLAACAAEGKIYTSGGSEVGNSALYLFECYDTRTESWHTKPSMLTQRCSHGMVEANGLIYVCGGSLGNNVSGRVLNSCEVYDPATETWTELCPMIEARKNHGLVFVKDKIFAVGGQNGLGGLDNVEYYDIKLNEWKMVSPMPWKGVTVKCAAVGSIVYVLAGFQGVGRLGHILEYNTETDKWVANSKVRAFPVTSCLICVVDTCGANEETLET

SEQ ID NO: 2525 - protein, 619 aa, Homo sapiens [sequence omitted]

SEQ ID NO: 2526 - protein, 264 aa, Homo sapiens
MYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKHSHVHTSDKPYTCKVRGCDKCYTHPSSLRKHMKVHGRSPPPSSGYDSATPSALVSPSSDCGHKSQVASSAAVAARTADLSE

SEQ ID NO: 2527 - protein, 100 aa, Homo sapiens [sequence omitted]

SEQ ID NO: 2528 - protein, 1003 aa, Homo sapiens
MNGGNESSGADRAGGPVATSVPIGWQRCVREGAVLYISPSGTELSSLEQTRSYLLSDGTCKCGLECPLNVPKVFNFDPLAPVTPGGAGVGPASEEDMTKLCNHRRKAVAMATLYRSMETTCSHSSPGEGASPQMFHTVSPGPPSARPPCRVPPTTPLNGGPGSLPPEPPSVSQAFPTLAGPGGLFPPRLADPVPSGGSSSPRFLPRGNAPSPAPPPPPAISLNAPSYNWGAALRSSLVPSDLGSPPAPHASSSPPSDPPLFHCSDALTPPPLPPSNNLPAHPGPASQPPVSSATMHLPLVLGPLGGAPTVEGPGAPPFLASSLLSAAAKAQHPPLPPPSTLQGRRPRAQAPSASHSSSLRPSQRRPRRPPTVFRLLEGRGPQTPRRSRPRAPAPVPQPFSLPEPSQPILPSVLSLLGLPTPGPSHSDGSFNLLGSDAHLPPPPTLSSGSPPQPRHPIQPSLPGTTSGSLSSVPGAPAPPAASKAPVVPSPVLQSPSEGLGMGAGPACPLPPLAGGEAFPFPSPEQGLALSGAGFPGMLGALPLPLSLGQPPPSPLLNHSLFGVLTGGGGQPPPEPLLPPPGGPGPPLAPGEPEGPSLLVASLLPPPPSDLLPPPSAPPSNLLASFLPLLALGPTAGGGEGSAEGAGGPSGEPFSGLGDLSPLLFPPLSAPPTLIALNSALLAATLDPPSGTPPQPCVLSAPQPGPPTSSVTTATTDPGASSLGKAPSNSGRPPQLLSPLLGASLLGDLSSLTSSPGALPSLLQPPGPLLSGQLGLQLLPGGGAPPPLSEASSPLACLLQSLQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPAKNKRRKLAP

SEQ ID NO: 2529 - protein, 113 aa, Homo sapiens
MAAPVVAPPGVVVSRANKRSGAGPGGSGGGGARGAEEEPPPPLQAVLVADSFDRRFFPISKDQPRVSAAHASSQRAGRVAGLEQVLISANYNSMPLKDLRLCCYPKTGCRGTV

SEQ ID NO: 2530 - protein, 325 aa, Homo sapiens [sequence omitted]

SEQ ID NO: 2531 - protein, 263 aa, Homo sapiens
MEINTKLLISVTCISFFTFQLLFYFVSYWFSAKVSPGFNSLSFKKKIEWNSRVVSTCHSLVVGIFGLYIFLFDEATKADPLWGGPSLANVNIAIASGYLISDLSIIILYWKVIGDKFFIMHHCASLYAYYLVLKNGVLAYIGNFRLLAELSSPFVNQRWFFEALKYPKFSKAIVINGILMTVVFFIVRIASMLPHYGFMYSVYGTEPYIRLGVLIQLSWVISCVVLDVMNVMWMIKISKGCIKVISHIRQEKAKNSLQNGKLD

SEQ ID NO: 2532 - protein, 451 aa, Homo sapiens
MGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPRDKETAPRLPQHRGWNPGDAPQTSQGRGTGTPVGAETKTLPSTDVAQPPSDSDAVGPRSGFPPQPSLPLCRAPGQLGEKQLPSSTSDDRVKDEFSDLSEGDVLSEDENDKKQNAQSSDESFEPYPERKVSGKKSESKEAKKSEEPRIRKKPGPKPGWKKKLRCEREELPTIYKCPYQGCTAVYRGADGMKKHIKEHHEEVRERPCPHPGCNKVFMIDRYLQRHVKLIHTAVMVSHCHRRPPGRLEHQGPGLTGLSPLRGAELYL

SEQ ID NO: 2533 - protein, 125 aa, Homo sapiens
MLYISEHCFSLDNFIFLSIPHFQVFFVLFCFVFVVVVLRQGLTVSPRLECSGTMTTHCSLNLLGPSDPPTSASQVAGTTEVHHHAWLFFFFWSRWGVPVLPRLVLNSWTQGILLSWAPKVLGLQA

SEQ ID NO: 2534 - protein, 101 aa, Homo sapiens
MCIRCYSTDSKRSGYPPVGSSRWQRKLVYNDSRSNGGGAYSSSAHNCYIHTIVISMPECLCLQKNVIAYFNVWSGLQSVLLCFYFSQWWWERNLILSIFFH

SEQ ID NO: 2535 - protein, 284 aa, Homo sapiens
MSDNKERKSQGFPKEDNQDTSSLADAVEKVAKQQQSQASEIEKNKKVLFNLKNELHELEKEIAAISAETKETERQIYQQDSAIENTKLHCDSLETQIKSLHSENVKLKFDIETAQEDFEEHMIKYNAYYAKIKAHKNSLGEVESKWSFMTELHEKRDFVKKLKTMKEELMQDLQNPGGNRITQVQEDITNLKDKIITVKESIIEKTCFLEEEKKTHEKLRKEIEGLAPSPRLECSSAISAHCKLCLPGSRHSPASASGVAGTTGACHHTQLIFCIFSRDGVSPC

SEQ ID NO: 2536 - protein, 469 aa, Homo sapiens
MTLLTSGGAGMLYVRWRIMGTGPPAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSVGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 2537 - protein, 105 aa, Homo sapiens
MWGARSGESGPWASMPGGDQKSGRHLPPALAFFPSTLEPHPHPPWGAQLGSDLMLQEAVTSEGTKEGGRACLARRPRSLSPPLSLPRWVRRFWPRWGRQGRVCEA

SEQ ID NO: 2538 - protein, 576 aa, Homo sapiens
MGYIASLHELATTERRFYSKLSDIKSQILRPLLSLENLGTTTTVQLLQEVASRFSKLCYLIGQHGASLSSFLHGVKEARSLVILKHSSLFLDSYTEYCTSITNFLVMGGFQLLAKPAIDFLNKNQELLQDLSEVNDENTQLMEILNTLFFLPIRRLHNYAKVLLKLATCFEVASPEYQKLQDSSSCYECLALHLGRKRKEAEYTLGFWKTFPGKMTDSLRKPERRLLCESSNRALSLQHAGRFSVNWFILFNDALVHAQFSTHHVFPLATLWAEPLSEEAGGVNGLKITTPEEQFTLISSTPQEKTKWLRAISQAVDQALRGMSDLPPYGSGSSVQRQEPPISRSAKYTFYKDPRLKDATYDGRWLSGKPHGRGVLKWPDGKMYSGMFRNGLEDGYGEYRIPNKAMNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKDNSGLIEQVGKCSLLPYFLKVCEALVLFLL

SEQ ID NO: 2539 - protein, 128 aa, Homo sapiens
MSISGTLSSYYVDSIISHESEDAPPAKFPSGQYASSRQPGHAEHLEFPSCSFQPKAPVFGASWAPLSPHASGSLPSVYHPYIQPQGVPPAESRYLRTWLEPAPRGGAAQTGHARVQFGNFGGQGGRAV

SEQ ID NO: 2540 - protein, 302 aa, Homo sapiens
MRNFFLMEGGDTMYDFYTSIFDKIREKETWQNVSFLNVQLQEAVGQRYPEDSSRLSISFENVDTAKKKLPVHILDGLTLSYKVPWPVDIVISLECQKIYNQVFLLLLQIKWAKYSLDVLLFGELVSTAEKPRLKEGLIHEQDTVAQFGPQKEPVRQQIHRMFLLRVKLMHFVNSLHNYIMTRILHSTGLEFQHQVEEAKDLDQLIKIHYRYLSTIHDRCLLREKVSFVKEAIMKVLNLALMFADGWQAGLGTWRMESIEKMESDFKNCHMFFVTILNKAVCRGSFPHCEYIMLKYFYLCISL

SEQ ID NO: 2541 - protein, 642 aa, Homo sapiens
MDPFRPSFRGQSPIHPSQCQAVRMPGCWPQASKPLDPALGRGAPAGRGHVFGKPEEPSTQRGPAQRESVGLVSMFRGLGIETVSKTPLKREMLPSGRGILGRGLSANLVRKDREELSPTFWDPKVLAAGDSKMAETSVGWSRTLGRGSSDASLLPLGRAAGGISREVDKPPCTFSTPSRGPPQLSSPPALPQSPLHSPDRPLVLTVEHKEKELIVKQGSKGTPQSLGLNLVKIQCHNEAVYQYHVTFSPNVECKSMRFGMLKDHQAVTGNVTAFDGSILYLPVKLQQVLELKSQRKTDSAEISIKIQMTKILEPCSDLCIPFYNVVFRRVMKLLDMKLVGRNFYDPTSAMVLQQHRLQIWPGYAASIRRTDGGLFLLADVSHKVIRNDCVLDVMHAIYQQNKEHFQDECTKLLVGNIVITRYNNRTYRIDDVDWNKTPKDSFTMSDGKEITFLEYYSKNYGITVKEEDQPLLIHRPSERQDNHGMLLKGEILLLPELSFMTGIPEKMKKDFRAMKDLAQQINLSPKQHHSALECLLQRIAKNEAATNELMRWGLRLQKDVHKIEGRVLPMERINLKNTSFITSQELNWVKEVTRDPSILTIPMHFWALFLPKESNGPGSRTGQHVGEDSRPHWHAYEPTGLG

SEQ ID NO: 2542 - protein, 1204 aa, Homo sapiens
MAAAAAVGNAVPCGARPCGVRPDGQPKPGPQPRALLAAGPALIANGDELVAAVWPYRRLALLRRLTVLPFAGLLYPAWLGAAAAGCWGWGSSWVQIPEAALLVLATICLAHALTVLSGHWSVHAHCALTCTPEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 2543 - protein, 582 aa, Homo sapiens
MTMLNQLYQLQLAYQRLQIQQQMLQAQRNVSGSMRQQEQQVARTITNLQQQIQQHQRQLAQALLVKQPPPPPPPPHLSLHPSAGKSAMDSFPSHPQTPGLPDLQTKEQQSSPNTFAPYPLAGLNPNMNVNSMDMTGGLSVKDPSQSQSRLPQWTHPNSMDNLPSAASPLEQNPSKHGAIPGGLSIGPPGKSSIDDSYGRYDLIQNSESPASPPVAVPHSWSRAKSDSDKISNGSSINWPPEFHPGVPWKGLQNIDPENDPDVTPGSVPTGPTINTTIQDVNRYLLKSGGSSPPSSQNATLPSSSAWPLSASGYSSSFSSIASAPSVAGKLSDIKSTWSSGPTSHTQASLSHELWKVPRNSTAPTRPPPGLTNPKPSSTWGASPLGWTSSYSSGSAWSTDTSGRTSSWLVLRNLTPQIDGSTLRTLCLQHGPLITFHLNLTQGNAVVRYSSKEEAAKAQKSLHMCVLGNTTILAEFAGEEEVNRFLAQGQALPPTSSWQSSSASSQPRLSAAGSSHGLVRSDAGHWNAPCLGGKGSSELLWGGVPQYSSSLWGPPSADDSRVIGSPTPLTTLLPGDLLSGESL

SEQ ID NO: 2544 - protein, 386 aa, Homo sapiens
MREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHQGRNDELERDERREERRVDRVDDRRDERARDRDRERERDRERERERERERDREREKERELERERAREREREREKERDRERDRDRDHDRERERERERDREKEREREREEREGERARTGERARARTGTRKSERKG

SEQ ID NO: 2545 - protein, 566 aa, Homo sapiens [sequence omitted]

SEQ ID NO: 2546 - protein, 492 aa, Homo sapiens [sequence omitted]

SEQ ID NO: 2547 - protein, 464 aa, Homo sapiens
MPLGPVTPALPLQCPTANLHKPGGSQQCHPPTPDTGPQNGHPEGVPHTPQRRFQHTSAVILQLQPASPVPQQCVPDDWKEVAPGEKSVPETRSGPSPHQQAIVTAMPGGLPVPTSPNIQPSPAHETGQGIVHALTDLSSPGMTSGNGNSASSIAGTAPQNGENKPPQAIVKPQILTHVIEGFVIQEGAEPFPVGRSSLLVGNLKKKYAQGFLPEKLPQQDHTTTTDSEMEEPYLQESKEEGAPLKLKCELCGRVDFAYKFKRSKRFCSMACAKRYNVGCTKRVGLFHSDRSKLQKAGAATHNRRRASKASLPPLTKDTKKQPTGTVPLSVTAALQLTHSQEDSSRCSDNSSYEEPLSPISASSSTSRRRQGQRDLELPDMHMRDLVGMGHHFLPSEPTKWNVEDVYEFIRSLPGCQEIAEEFRAQEIDGQALLLLKEDHLMSAMNIKLGPALKIYARISMLKDS

SEQ ID NO: 2548 - protein, 109 aa, Homo sapiens
MKLARAQWLSVWSCLLTAGGRIHVFLLDLILPVHGMMQSVHERKSLRDECLIVWSCLQSAHDWLCLHHGTWGVWSHLLTAPTQIHDGFWKPTQSASQSLLSVPHCPCPG

SEQ ID NO: 2549 - protein, 782 aa, Homo sapiens
MNPEKDFAPLTPNIVRALNDKLYEKRKVAALEIEKLVREFVAQNNTVQIKHVIQTLSQEFALSQHPHSRKGGLIGLAACSIALGKDSGLYLKELIEPVLTCFNDADSRLRYYACEALYNIVKVARGAVLPHFNVLFDGLSKLAADPDPNVKSGSELLDRLLKDIVTESNKFDLVSFIPLLRERIYSNNQYARQFIISWILVLESVPDINLLDYLPEILDGLFQILGDNGKEIRKMCEVVLGEFLKEIKKNPSSVKFAEMANILVIHCQTTDDLIQLTAMCWMREFIQLAGRVMLPYSSGILTAVLPCLAYDDRKKSIKEVANVCNQSLMKLVTPEDDELDELRPGQRQAEPTPDDALPKQEGTASGGPDGSCDSSFSSGISVFTAASTERAPVTLHLDGIVQVLNCHLSDTAIGMMTRIAVLKWLYHLYIKTPRKMFRHTDSLFPILLQTLSDESDEVILKDLEVLAEIASSPAGQTDDPGPLDGPDLQASHSELQVPTPGRAGLLNTSGTKGLECSPSTPTMNSYFYKFMINLLKRFSSERKLLEVRGPFIIRQLCLLLNAENIFHSMADILLREEDLKFASTMVHALNTILLTSTELFQLRNQLKDLKTLESQNLFCCLYRSWCHNPVTTVSLCFLTQNYRHAYDLIQKFGDLEVTVDFLAEVDKLVQLIECPIFTYLRLQLLDVKNNPYLIKALYGLLMLLPQSSAFQLLSHRLQCVPNPELLQTEDSLKAAPKSQKADSPSIDYAELLQHFEKVQNKHLEVRHQRSGRGDHLDRRVVL

SEQ ID NO: 2550 - protein, 1066 aa, Homo sapiens
MQSTDLGNKESGKIWHRKPSPATRDGIIVNIIHNTSDYHPKVLRFLNVAFDGTGDCLIAGDHQGNIYVFDLHGNRFNLVQRTAQACTALAFNLRRKSEFLVALADYSIKCFDTVTKELVSWMRGHESSVFSISVHASGKYAITTSSDTAQLWDLDTFQRKRKLNIRQSVGIQKVFFLPLSNTILSCFKDNSIFAWECDTLFCKYQLPAPPESSSILYKVFAVTRDGRILAAGGKSNHLHLWCLEARQLFRIIQMPTKVRAIRHLEFLPDSFDAGSNQVLGVLSQDGIMRFINMQTCKLLFEIGSLDEGISSSAISPHGRYIASIMENGSLNIYSVQALTQEINKPPPPLVKVIEDLPNNKLSSSDLKMKVTSGRVQQPAKSRESKMQTRILKQDLTGDFESKKNELPDGLNKKRLQILLKGYGEYPTKYRMFIWRSLLQLPENHTAFSTLIDKGTHVAFLNLQKKYPIKSRKLLRVLQRTLSALAHWSVIFSDTPYLPLLAFPFVKLFQNNQLICFEVIATLIINWCQHWFEYFPNPPINILSMIENVLAFHDKELLQHFIDHDITSQLYAWPLLETVFSEVLTREEWLKLFDNIFSNHPSFLLMTVVAYNICSRTPLLSCNLKDDFEFFFHHRNNLDINVVIRQVYHLMETTPTDIHPDSMLNVFVALTKGQYPVFNQYPKFIVDYQTQERERIRNDELDYLRERQTVEDMQAKVDQQRVEDEAWYQKQELLRKAEETRREMLLQEEEKMIQQRQRLAAVKRELKVKEMHLQDAARRRFLKLQQDQQEMELRRLDDEIGRKVYMRDREIAATARDLEMRQLELESQKRLYEKNLTENQEALAKEMRADADAYRRKVDLEEHMFHKLIEAGETQSQKTQKVIKENLAKAEQACLNTDWQIQSLHKQKCDDLQRNKCYQEVAKLLRENRRKEIEIINAMVEEEAKKWKEAEGKEFRLRSAKKASALSDASRKWFLKQEINAAVEHAENPCHKEEPRFQNEQDSSCLPRTSQLNDSSEMDPSTQISLNRRAVEWDTTGQNLIKKVRNLRQRLTARARHRCQTPHLLAA

SEQ ID NO: 2551 - protein, 591 aa, Homo sapiens
MASYLLPGQKSPWFFQKPKGVITLDKQVISTSSDAESREEVPMCSDAESRQEVPMCTGPESRREVPVYTDSEPRQEVPMCSDPEPRQEVPTCTGPESRREVPMCSDPEPRQEVPMCTGPEARQEVPMYTDSEPRQEVPMYTDSEPRQEVPMYTGSEPRQEVPMYTGPESRQEVPMYTGPESRQEVLIRTDPESRQEIMCTGHESKQEVPICTDPISKQEDSMCTHAEINQKLPVATDFEFKLEALMCTNPEIKQEDPTNVGPEVKQQVTMVSDTEILKVARTHHVQAESYLVYNIMSSGEIECSNTLEDELDQALPSQAFIYRPIRQRVYSLLLEDCQDVTSTCLAVKEWFVYPGNPLRHPDLVRPLQMTIPGGTPSLKILWLNQEPEIQVRRLDTLLACFNLSSSREELQAVESPFQALCCLLIYLFVQVDTLCLEDLHAFIAQALCLQGKSTSQLVNLQPDYINPRAVQLGSLLVRGLTTLVLVNSACGFPWKTSDFMPWNVFDGKLFHQKYLQSEKGYAVEVLLEQNRSRLTKFHNLKAVVCKACMKGNRRITGRAHWGSHHAGGKGPGASRSPTSVDPNCFLSFVDK

SEQ ID NO: 2552 - protein, 221 aa, Homo sapiens
MGEKSRRKGPAPRHADGKLGRTCDHPYAPWSFTPSSRAPTAWVRPPCPVWASRLQEHSPEPRRARAPPTRRAQAALYAPALRLRDHLDRFSILMTSCTSWLQAPQAPGLCRDEQSSRISVPQLSGAPILLPDLEGTKLSNFQESSPLPHKHERKDKRSTPEEEGRSAPEKIIQSLKLCPGGHRPASLSSGCPAGCRLSFNLPPSMLLSVQKCCMPSSLKTC

SEQ ID NO: 2553 - protein, 439 aa, Homo sapiens
MAAPDLAHGGHVSRDSVCLHEEQTQAAGMVAGWLINCYQDAVTFDDVAVDFTQEEWTLLDPSQRDLYRDVMLENYENLASVEWRLKTKGPALRQDRSWFRASNETQTARSHNGGQLCDRTQCGEAFSEHSGLSTHVRTQNTGDSCVSNHYERDFFIPCQKTLFTIGEQFSVLGQCGKAFSSTPNVVSQQACTRDRSLDYSSCGEVFLNQSYLQARAGSHNGEETWKWKPCGKALTHSMGCATPVEMHAVRNPHVCRECGKAFRYTAYLTGRVQVHPGEKPCELEECGKASPVSSSLTQHVRIHAAEKPCECKECGKAFTGLSGLSKHVQTDPGQKPYECKDCGKACGGFYLLNEHGKTHTREKPFACVVCGKYFRNSSCLNNHVRIHTGIKPIHAATVGRPSLCAVALLDTYEHTRARSHTRVRTAGKPSVHPRALLSM

SEQ ID NO: 2554 - protein, 113 aa, Homo sapiens [sequence omitted]

SEQ ID NO: 2555 - protein, 594 aa, Homo sapiens
MFTVPTLARHLIEEQNVISVITETLLEVLPEYLDRNNKFNFQGYSQDKLGRVYAVICDLKYILISKPTIWTERLRMQFLEGFRSFLKILTCMQGMEEIRRQVGQHIEVDPDWEAAIAIQMQLKNILLMFQEWCACDEELLLVAYKECHKAVMRCSTSFISSSKTVVQSCGHSLETKSYRVSEDLVSIHLPLSRTLAGLHVRLSRLGAVSRLHEFVSFEDFQVEVLVEYPLRCLVLVAQVVAEMWRRNGLSLISQVFYYQDVKCREEMYDKDIIMLQIGASLMDPNKFLLLVLQRYELAEAFNKTISTKDQDLIKQYNTLIEEMLQVLIYIVGERYVPGVGNVTKEEVTMREIIHLLCIEPMPHSAIAKNLPENENNETGLENVINKVATFKKPGVSGHGVYELKDESLKDFNMYFYHYSKTQHSKAEHMQKKRRKQENKDEALPPPPPPEFCPAFSKVINLLNCDIMMYILRTVFERAIDTDSNLWTEGMLQMAFHILALGLLEEKQQLQKAPEEEVTFDFYHKASRLGSSAMNIQMLLEKLKGIPQLEGQKDMITWILQMFDTVKRLREKSCLIVATTSGSESIKNDEITHDK

SEQ ID NO: 2556 - protein, 705 aa, Homo sapiens [sequence omitted]

SEQ ID NO: 2557 - protein, 206 aa, Homo sapiens
MDELALSFSLTCLLPENRASLSPSQPLSFQCLKAPATLTWEDEKQQSWGQPHGPVSTPLLGDHRCLVPFRDLNPSSEVNTANLLESPSSLLLTSCYICSYFSFYILGEKRCHSLKRLRYSVCCKVCPNFCACGKENVSGTGQVCTGVHVGAKEQEEPGGTQALRSCGIYCLEERTDKASHEECRERSTLGRPQCTGLTPSLAGESP

SEQ ID NO: 2558 - protein, 385 aa, Homo sapiens
MTLLHYACKAGAHGVGDPAAAVRLSQQLLALGADVTLRSRWTNMNALHYAAYFDVPDLVRVLLKGARPRVVNSTCSDFNHGSALHIAASSLCLGAAKCLLEHGANPALRNRKGQVPAEVVPDPMDMSLDKAEAALVAKELRTLLEEAVPLSCALPKVTLPNYDNVPGNLMLSALGLRLGDRVLLDGQKTGTLRFCGTTEFASGQWVGVELDEPEGKNDGSVGGVRTSSALPSRVSLPPCPRSPRQWTHPPPLSPPHPGPPGWTSPVSPAKAAGNTKARRRPHHPHLWAACSSVTGPRLRLETRSLSRARSRGSCASTGRQTLPQVTGMALSWTSPQASVMALSSVSGTSLAPRGMGSSHQHPVFRGLADPLIPPGTALEPKKCIK

SEQ ID NO: 2559 - protein, 854 aa, Homo sapiens
MPPCSGGDGSTPPGPSLRDRDCPAQSAEYPRDRLDPRPGSPSEASSPPFLRSRAPVNWYQEKAQVFLWHLLVSGSTTLLCLWKQPFHVSAFPVTASLAFRQSQGAGQHLYKDLQPFILLRLLMPEETQTQDQPMEEEEVETFAFQAEIAQLMSLIINTFYSNKEIFLRELISNSSDALDKIRYESLTDPSKLDSGRELHINLIPNKQGRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 2560 - protein, 708 aa, Homo sapiens [sequence omitted]

SEQ ID NO: 2561 - protein, 140 aa, Homo sapiens
MGSHSCSSTGDPSPSQETRRTAVRKPRVRSAGWSWPWLTRCVTWGAAPLRLVVWRGECARARVCWGRGRTSLLGALPAPWGAHPCFRPPSPGPGTRGGHSPGARALGLGTHPAGAAAGWAPSGPPSEAPGEAGKMWSSER

SEQ ID NO: 2562 - protein, 568 aa, Homo sapiens
MDTEDFPGPELPPPAAEGASSVQQTQNVKASTSSPMEEAISLATDALKRVPGAGSSGCRLSSVEANNPLVTQLLQGNLPLEKVLPQPRLGAKLEINRLPLPLQTTSVGKTAPERNVEIPPSSPNPDGKGYLAGTLAPLQMRKRENHPKKRVARTVGEHTQVKCEPGKLLVEPDVKGVPCVISSGISQLGHSQPFKQEWLNKHSMQNRIVHSPEVKQQKRLLPSCSFQQNLFHVDKNGGFHTDAGTSHRQQFYQMPVAARGPIPTAALLQASSKTPVGCNAFAFNRHLEQKGLGEVSLSSAPHQLRLANMLSPNMPMKEGDEVGGTAHTMPNKALVHPPPPPPPPPPPPLALPPPPPPPPPLPPPLPNAEVPSDQKQPPVTMETTKRLSWPQSTGICSNIKSEPLSFEEGLSSSCELGMKQVSYDQNEMKEQLKAFALKSADFSSYLLSEPQKPFTQLAAQKMQVQQQQQLCGNYPTIHFGSTSFKRAASAIEKSIGILGSGSNPATGLSGQNAQMPVQNFADSSNADELELKCSCRLKAMIVCKGCGAFCHDDCIGPSKLCVACLVVR

SEQ ID NO: 2563 - protein, 199 aa, Homo sapiens [sequence omitted]

SEQ ID NO: 2564 - protein, 456 aa, Homo sapiens
MNKFQGPVTLKDVIVEFTKEEWKLLTPAQRTLYKDVMLENYSHLVSVGYHVNKPNAVFKLKQGKEPWILEVEFPHRGFPEDLWSIHDLEARYQESQAGNSRNGELTKHQKTHTTEKACECKECGKFFCQKSALIVHQHTHSKGKSYDCDKCGKSFSKNEDLIRHQKIHTRDKTYECKECKKIFYHLSSLSRHLRTHAGEKPYECNQCEKSFYQKPHLTEHQKTHTGEKPFECTECGKFFYVKAYLMVHQKTHTGEKPYECKECGKAFSQKSHLTVHQRMHTGEKPYKCKECGKFFSRNSHLKTHQRSHTGEKPYECKECRKCFYQKSALTVHQRTHTGEKPFECNKCGKTFYYKSDLTKHQRKHTGEKPYECTECGKSFAVNSVLRLHQRTHTGEKPYACKECGKSFSQKSHFIIHQRKHTGEKPYECQECGETFIQKSQLTAHQKTHTKKRNAEK

SEQ ID NO: 2565 - protein, 290 aa, Homo sapiens
MLSFPLFKDDLCKDDFKTSKGGAHCFPELRVGVFEEIVPMGISPKKISYKKPGIHLSPGEFHKEVEKFLSQANQEQSNTILLDCRNFYESKIGRFQGCLAPDIRKFSYFPSYVDKNLELFREKRVLMYCTGGIRCERGSAYLKAKGVCKEVFQLKGGIHKYLEEFPDGFYKGKLFVFDERYALSYNSDVVSECSYCGARWDQYKLCSTPQCRQLVLTCPACQGQGFTACCVTCQDKGSRKVSGPMQDSFKEECECTARRPRIPRELLQHVRQPVSPEPGPDADEDGPVLM

SEQ ID NO: 2566 - protein, 772 aa, Homo sapiens [sequence omitted]

SEQ ID NO: 2567 - protein, 150 aa, Homo sapiens [sequence omitted]

SEQ ID NO: 2568 - protein, 990 aa, Homo sapiens [sequence omitted]

SEQ ID NO: 2569 - protein, 718 aa, Homo sapiens [sequence omitted]

SEQ ID NO: 2570 - protein, 955 aa, Homo sapiens
MSSASVTAFEKEHLWMYLQALGFEPGPATIACGKIVSHTHLGVNMFDKLNRDAFHIISYFLFQVLDQSLTKEVFKFCWPPFDQKSDTEFRKHCCEWIKRISGECGSSFPQVVGSLFLSPGGPKFIHLMYHFARFVAMKYIKSNSKNSSHHFVETFNIKPQDLHKCIARCHFARSRFLQILQRQDCVTQKYQENAQLSVKQVRNLRSECIGLENQIKKMEPYDDHSNMEEKIQKVRSLWASVNETLMFLEKEREVVSSVLSLVNQYALDGTNVAINIPRLLLDKIEKQMFQLHIGNVYEAGKLNLLTVIQLLNEVLKVMKYERCQADQARLTVDLHYLEKETKFQKERLSDLKHMRYRIKDDLTTIRHSVVEKQGEWHKKWKEFLGLSPFSLIKGWTPSVDLLPPMSPLSFDPASEEVYAKSILCQYPASLPDAHKQHNQENGCRGDSDTLGALHDLANSPASFLSQSVSSSDRNSVTVLEKDTKMGTPKEKNEAISKKIPEFEVENSPLSDVAKNTESSAFGGSLPAKKSDPFQKEQDHLVEEVARAVLSDSPQLSEGKEIKLEELIDSLGSNPFLTRNQIPRTPENLITEIRSSWRKAIEMEENRTKEPIQMDAEHREVLPESLPVLHNQREFSMADFLLETTVSDFGQSHLTEEKVISDCECVPQKHVLTSHIDEPPTQNQSDLLNKKVICKQDLECLAFTKLSETSRMETFSPAVGNRIDVMGGSEEEFMKILDHLEVSCNKPSTNKTMLWNSFQISSGISSKSFKDNDFGILHETLPEEVGHLSFNSSSSSEANFKLEPNSPMHGGTLLEDVVGGRQTTPESDFNLQALRSRYEALKKSLSKKREESYLSNSQTPERHKPELSPTPQNVQTDDTLNFLDTCDLHTEHIKPSLRTSIGERKRSLSPLIKFSPVEQRLRTTIACSLGELPNLKEEDILNKSLDAKEPPSDLTR

SEQ ID NO: 2571 - protein, 331 aa, Homo sapiens
MPDKTATPERPPAPENAPSSKKIPAPDKVPSPEKTLTLGDKASIPGNSTSGKIPAPDKVPTPEKMVTPEDKASIPENSIIPEETLTVDEPSTPERVFSVEESPALEAPPMDKVPNPKMAPLGDEAPTLEKVLTPELSEEEVSTRDDIQFHHFSSEEALQKVKYFVAKEDPSSQEGAHTPEAPPPQPPSSERCLGEMKCTLVRGDSSPRQAELKSGPASRPALEKPHPHEEATTLPEEAPSNDERTPEEEAPPNEQRPLREEVLPKEGVASKEEVTLKEELPPKEEVAPKEEVPPIERAFAQKNTSYQAASRLPRDARAPLAGPAKLHGKQE

SEQ ID NO: 2572 - protein, 363 aa, Homo sapiens
MNALSGSWASAPPMASDAVPGQEGSDIEAGELNHQNGEPTEVEDGTVDGADRDEKDFRNPGQEVRKLDLPVLFPNRLGFEFKNEIKKENLKWDDSEEVEINKALQRKSRGVYWHSELQKGLESEPTSRRQCRNSPGESEEKTPSQEKMSHQSFCARDKACTHILCGKNCSQSVHSPHKPALKLEKVSQCPECGKTFSRSSYLVRHQRIHTGEKPHKCSECGKGFSERSNLTAHLRTHTGERPYQCGQCGKSFNQSSSLIVHQRTHTGEKPYQCIVCGKRFNNSSQFSAHRRIHTGESPYKCAVCGKIFNNSSHFSAHRKTHTGEKPYRCSHCERGFTKNSALTRHQTVHMKAVLSSQEGRDAL

SEQ ID NO: 2573 - protein, 824 aa, Homo sapiens [sequence omitted]

SEQ ID NO: 2574 - protein, 703 aa, Homo sapiens
MEALLEGIQNRGHGGGFLTSCEAELQELMKQIDIMVAHKKSEWEGRTHALETCLKIREQELKSLRSQLDVTHKEVGMLHQQVEEHEKIKQEMTMEYKQELKKLHEELCILKRSYEKLQKKQMREFRGNTKNHREDRSEIERLTAKIEEFRQKSLDWEKQRLIYQQQVSSLEAQRKALAEQSEIIQAQLVNRKQKLESVELSSQSEIQHLSSKLERANDTICANELEIERLTMRVNDLVGTSMTVLQEQQQKEEKLRESEKLLEALQEEKRELKAALQSQENLIHEARIQKEKLQEKVKATNTQHAVEAIRPREESLAEKKYTSQGQGDLDSVLSQLNFTHTSEDLLQAEVTCLEGSLESVSATCKQLSQELMEKYEELKRMEAHNNEYKAEIKKLKEQILQGEQSYSSALEGMKMEISHLTQELHQRDITIASTKGSSSDMEKRLRAEMQKAEDKAVEHKEILDQLESLKLENRHLSEMVMKLELGLHEAKEISLADLQENYIEALNKLVSENQQLQKDLMNTKSQLEISTQMCKKQNDRIFKPTHSRTTEFKNTEFKPTHGQHRHDGIKTEHYKTDLHSPRGQASDSINPMSRVLSPLSPQISPCSSTRSLTSYSLCKTHSLPSALDTNEANFSDTMSESMNDQEEFISSCSLPVSPLGSIATRFLEEEELRSHHILERLDAHIEELKRESEKTVRQFTALK

SEQ ID NO: 2575 - protein, 838 aa, Homo sapiens [sequence omitted]

SEQ ID NO: 2576 - protein, 1054 aa, Homo sapiens [sequence omitted]

SEQ ID NO: 2577 - protein, 1024 aa, Homo sapiens
MASSSGTATNRPGKNLKAFVAAKRPIAARPSPGGVFTQFVMSKVGALQQKIPGVSTPQTLAGTQKFSIRPSPVMVVTPVVSSEPVQVCSPVTAAVTTTTPQVFLENTTAVTPMTAISDVETKETTYSSGATTTGVVEVSETNTSTSVTSTQSTATVNLTKTTGITTPVASVAFPKSLVASPSTITLPVASTASTSLVVVTAAASSSMVTTPTSSLGSVPIILSGINGSPPVSQRPENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEA

SEQ ID NO: 2578 - protein, 850 aa, Homo sapiens
MVPTAAIAVGGYFLGGMEEKRRKYSISSDNSDTTDSHATSTSASRCSKLPSSTKSGWPRQNEKKPSEVFRTDLITAMKIPDSYQLSPDDYYILADPWRQEWEKGVQVPAGAEAIPEPVVRILPPLEGPPAQASPSSTMLGEGSQPDWPGGSRYDLDEIDAYWLELINSELKEMERPELDELTLERVLEELETLCHQNMARAIETQEGLGIEYDEDVVCDVCRSPEGEDGNEMVFCDKCNVCVHQACYGILKVPTGSWLCRTCALGVQPKCLLCPKRGGALKPTRSGTKWVHVSCALWIPEVSIGCPEKMEPITKISHIPASRWALSCSLCKECTGTCIQCSMPSCVTAFHVTCAFDHGLEMRTILADNDEVKFKSFCQEHSDGGPRNEPTSEPTEPSQAGEDLEKVTLRKQRLQQLEEDFYELVEPAEVAERLDLAEALVDFIYQYWKLKRKANANQPLLTPKTDEVDNLAQQEQDVLYRRLKLFTHLRQDLERVRNLCYMVTRRERTKHAICKLQEQIFHLQMKLIEQDLCRERSGRRAKGKKSDSKRKGCEGSKGSTEKKEKVKAGPDSVLGQLAGLSTSFPIDGTFFNSWLAQSVQITAENMAMSEWPLNNGHREDPAPGLLSEELLQDEETLLSFMRDPSLRPGDPARKARGRTRLPAKKKPPPPPPQDGPGSRTTPDKAPKKTWGQDAGSGKGGQGPPTRKPPRRTSSHLPSSPAAGDCPILATPESPPPLAPETPDEAASVAADSDVQVPGPAASPKPLGRLRPPRESKVTRRLPGARPDAGMGPPSAVAERPKVSLHFDTETDGYFSDGEMSDSDVEAEDGGVQRGPREAGAEEVVRMGVLAS

SEQ ID NO: 2579 - protein, 982 aa, Homo sapiens
MKEPDDQDTDGEKSVTSKSDGKKSLRSSKSESRSPVQEDNTFLEDDTDETFTKGEGSYLEEDSDEERLEGSLSSFQYGDLQSTTVPQQTPAPAVEEAEEEVKKKISESFFYDYMELASMPFVTLDSNIPLDLLTLVHSFGYDCRKRANLQLLDDSIAIYIAGNQLIFLNLKTKEQIYLRSSSGEGIGVIGVHPHKTYFTVAEKGSFPDIIIYEYPSLRPYRVLRDGTEKGYAYVDFNYSGNLLASVGSNPDYTLTIWNWKEEQPILRTKAFSQEVFKVTFNPDKEEQLTTSGSGHIKFWEMAFTFTGLKLQGSLGRFGKTITTDIEGYMELPDGKVLSGSEWGNMLLWEGGLIKVELCRGTSKSCHNGPINQIMLYEGEVITVGSDGYVRIWDFETIDTADVIDETGLLEIEPINELQVDKNVNLFSMIKMNETGNNFWLAQDANGAIWKLDLSFSNITQDPECLFSFHSGAIEAVAVSPLTYLMATTALDCSVRIYDFASKTPLAQMKFKQGGTALVWVPRMVNFTGAQIIVGFEDGVVRILELYDPKGLTIFAGRKKILDADIQLKQVFKPHTACVTALAYERDGEILATGSKDQTVFFFEVERDYKPIGYINTPGPVCQLMWSPMSHPESTLLIICENGYILEAPLPTIKQEEDDHDVVSYEIKDMCIKCFHFSSVKSKILRLIEIEKRERQRELKEKIREERRNKLAAEMGEDGEKEFQEEEEEKEEEEEEEEPLPEIFIPSTPSPILCGFYSEPGKFWVSLGGYDSGFLYHCEFPPCDESSDFKEQKDEPIDVRYLADTEDNPIQTITFNINKVMMFCGMKNGAIRVYVLNQNDPSLTSLVDYWHFNMHDNNYGCIKSIANSFDDRFLVTAGADGNIFVFNIFSEFMLRKDMKAKVPSPRFGIETEPIPEDIEDPKAYSIENARRKREHDKLMKEVGEIKARKREQIKALRSEFCNLLEMNEKLPKHMQFKRTVSLI

SEQ ID NO: 2580 - protein, 121 aa, Homo sapiens
MEAEVDKLELMFQKAESDLDYIQYRLEYEIKTNHPDSASEKNPVTLLKELSVIKSRYQTLYARFKPVAVEQKESKSRICATVKKTMNMIQKLQKQTDLELSPLTKEEKTAAEQFKFHMPDL

SEQ ID NO: 2581 - protein, 124 aa, Homo sapiens [sequence omitted]

SEQ ID NO: 2582 - protein, 105 aa, Homo sapiens
MFISNLFLILCFLFRPTKTTVMYLIHLYQVLKYLDKSKYFVFSFFLLSILLTTVKRCSILIWSVLRRKTMKAELVCATQSKPLLFFWKDGVMFFKDSNKYPAVIS

SEQ ID NO: 2583 - protein, 637 aa, Homo sapiens
MESEYVLCDWKDQLWPAKVLSRSETSSNSKRKKAFSLEVQILSLDEKIKLDSTETKILNKSQIEAIAASLGLQSEDSAPPTEETAYGRSLKVALGILNERTNLSQASTSDEEEITMLSQNVPQKQSDSPPHKKYRKDEGDLPGCLEERENSACLLASSESDDSLYDDKSQAPTMVDTIPSEVETKSLQNSSWCETFPSLSEDNDEKENKNKIDISAVMSVHSAVKEESACVKDEKFAPPLSPLSSDMLIMPKALKEESEDTCLETLAVPSECSAFSENIEDPGEGPSNPCLDTSQNQPSMESEMGAAACPGSCSRECEVSFSASNPVWDYSHLMSSERNFQRLDFEELEEEGQASDKSLLPSRINLSLLDDDEEDEELPRFILHYETHPFETGMIVWFKYQKYPFWPAVIKSIRRKERKASVLFVEANMNSEKKGIRVNFRRLKKFDCKEKQMLVDKAREDYSESIDWCISLICDYRVRIGCGSFTGSLLEYYAADISYPVRKETKQDTFRNKFPKLHNEDAREPMAVTSQTKKMSFQKILPDRMKAARDRANKNLVDFIVNAKGTENHLLAIVNGTKGSRWLKSFLNANRFTPCIETYFEDEDQLDEVVKYLQEVCNQIDQIMPTWIKDDKIKFIL

SEQ ID NO: 2584 - protein, 418 aa, Homo sapiens [sequence omitted]

SEQ ID NO: 2585 - protein, 176 aa, Homo sapiens [sequence omitted]

SEQ ID NO: 2586 - protein, 155 aa, Homo sapiens [sequence omitted]

SEQ ID NO: 2587 - protein, 129 aa, Homo sapiens
MKLSAAPRVWQSLIFKSPCPLRLLPPAGPGSPRLRAPAPHRRFAPRPRAPPRPPPRLCFRLLLLSLLFCVGPDSAPETSHPAASDCQGSLTPRGGVSLCRPGWSTVVRSWLPATSASQVQAIFLPQLPE

SEQ ID NO: 2588 - protein, 123 aa, Homo sapiens
MAAKGAGGDAPGRGLAGSGTKLPKAAASVNCAWQGGSHTGSDPRRWLPRGDWRQCLPPMWASGLGSPELCPAAGCTERGGLLNGPCPRGASGKEIHLHPQNTPCPLEALGAGCPSNREKPHAV

SEQ ID NO: 2589 - protein, 121 aa, Homo sapiens
MGCASAKHVATVQNEEEAQKGKNYQNGDVFGDEYRIKPVEEVKYMKNGAEEEQKIAARNQENLEKSASSNVRLKTNKEVPGLVHQPRANMHISESQQEFFRMLDEKIEKGRDYCSEEEDIT

SEQ ID NO: 2590 - protein, 122 aa, Homo sapiens
MEFVNFLKNPKQYQDLGAKIPKGAMLTGPPGTGKTLLAKATAGEATVPFITVNGSEFLEMFIGVGPARGSTLPPTSWCWLAPTALTSWTRPSCGLAGFIARFTLVPLTLKAGPPSLRSTCAH

SEQ ID NO: 2591 - protein, 538 aa, Homo sapiens
MVAGWLTNYSQDSVTFEDVAVDFTQEEWTLLDQTQRNLYRDVMLENYKNLVAVDWESHINTKWSAPQQNFLQGKTSSVVEMERNHFGEELFDFNQCEKALSEHSCLKTHRRTYFRKKTCECNQCEKAFRKPSIFTLHKKTDIGEELPNCNQCETAFSQHLHLVCKKTSQNLHLVCKKTHTQEKPYKCSDCEKGLPSSSHLRECVRIYGGERPYTHKEYVETFSHSTALFVHMLTQDGEKFYECKACGKPFTESSYLTQHLRTHSRVLPIEHKKFGKAFAFSPDLAKHIRLRTRGKHYVCNECGKEFTCFSKLNIHIRVHTGEKPYECNKCGKAFTDSSGLIKHRRTHTGEKPYECKECGKAFANSSHLTVHMRTHTGEKPYQCKECGKAFINSSSFKSHMQTHPGVKPYDCQQCGKAFIRSSFLIRHLRSHSAERPFECEECGKAFRYSSHLSQHKRIHTGERPYKCQKCGQAFSISSGLTVHMRTHTGERPFECQECGKAFTRSTYLIRHLRSHSVEKPYKECGQTFSNSSCLTECV

SEQ ID NO: 2592 - protein, 163 aa, Homo sapiens [sequence omitted]

SEQ ID NO: 2593 - protein, 425 aa, Homo sapiens [sequence omitted]

SEQ ID NO: 2594 - protein, 1020 aa, Homo sapiens
MVKLDIHTLAHHLKQERLYVNSEKQLIQRLNADVLKTAEKLYRTAWIAKQQRINLDRLIITSAEASPAECCQHAKILEDTQFVDGYKQLGFQETAYGEFLSRLRENPRLIASSLVAGEKLNQENTQSVIYTVFTSLYGNCIMQEDESYLLQVLRYLIEFELKESDNPRRLLRRGTCAFSILFKLFSEGLFSAKLFLTATLHEPIMQLLVEDEDHLETDPNKLIERFSPSQQEKLFGEKGSDRFRQKVQEMVESNEAKLVALVNKFIGYLKQNTYCFPHSLRWIVSQMYKTLSCVDRLEVGEVRAMCTDLLLACFICPAVVNPEQYGIISDAPINEVARFNLMQVGRLLQQLAMTGSEEGDPRTKSSLGKFDKSCVAAFLDVVIGGRAVETPPLSSVNLLEGLSRTVVYITYSQLITLVNFMKSVMSGDQLREDRMALDNLLANLPPAKPGKSSSLEMTPYNTPQLSPATTPANKKNRLPIATRSRSRTNMLMDLHMDHEGSSQETIQEVQPEEVLVISLGTGPQLTPGMMSENEVLNMQLSDGGQGDVPVDENKLHGKPDKTLRFSLCSDNLEGISEGPSNRSNSVSSLDLEGESVSELGAGPSGSNGVEALQLLEHEQATTQDNLDDKLRKFEIRDMMGLTDDRDISETVSETWSTDVLGSDFDPNIDEDRLQEIAGAAAENMLGSLLCLPGSGSVLLDPCTGSTISETTSEAWSVEVLPSDSEAPDLKQEERLQELESCSGLGSTSDDTDVREVSSRPSTPGLSVVSGISATSEDIPNKIEDLRSECSSDFGGKDSVTSPDMDEITHDFLYILQPKQHFQHIEAEADMRIQLSSSAHQLTSPPSQSESLLAMFDPLSSHEGASAVVRPKVHYARPSHPPPDPPILEGAVGGNEARLPNFGSHVLTPAEMEAFKQRHSYPERLVRSRSSDIVSSVRRPMSDPSWNRRPGNEERELPPAAAIGATSLVAAPHSSSSSPSKDSSRGETEERKDSDDEKSDRNRPWWRKRFVSAMPKAPIPF

SEQ ID NO: 2595 - protein, 1060 aa, Homo sapiens
MGLGKTVQIIAFLSGMFDASLVNHVLLIMPTNLINTWVKEFIKWTPGMRVKTFHGPSKDERTRNLNRIQQRNGVIITTYQMLINNWQQLSSFRGQEFVWDYVILDEAHKIKTSSTKSAICARAIPASNRLLLTGTPIQNNLQELWSLFDFACQGSLLGTLKTFKMEYENPITRAREKDATPGEKALGFKISENLMAIIKPYFLRRTKEDVQKKKSSNPEARLNEKNPDVDAICEMPSLSRKNDLIIWIRLVPLQEEIYRKFVSLDHIKELLMETRSPLAELGVLKKLCDHPRLLSARACCLLNLGTFSAQDGNEGEDSPDVDHIDQVTDDTLMEESGKMIFLMDLLKRLRDEGHQTLVFSQSRQILNIIERLLKNRHFKTLRIDGTVTHLLEREKRINLFQQNKDYSVFLLTTQVGGVGLTLTAATRVVIFDPSWNPATDAQAVDRVYRIGQKENVVVYRLITCGTVEKKIYRRQVFKDSLIRQTTGEKKNPFRYFSKQELRELFTIEDLQNSVTQLQLQSLHAAQRKSDIKLDEHIAYLQSLGIAGISDHDLMYTCDLSVKEELDVVEESHYIQQRVQKAQFLVEFESQNKEFLMEQQRTRNEGAWLREPVFPSSTKEKCPKLNKPQPQPSPLLSTHHTQEEDISSKMASVVIDDLPKEGEKQDLSSIKVNVTTLQDGKGTGSADSIATLPKGFGSVEELCTNSSLGMEKSFATKNEAVQKETLQEGPKQEALQEDPLESFNYVLSKSTKADIGPNLDQLKDDEILRHCNPWPIISITNESQNAESNVSIIEIADDLSASHSALQDAQASEAKLEEEPSASSPQYACDFNLFLEDSADNRQNFSSQSLEHVEKENSLCGSAPNSRAGFVHSKTCLSWEFSEKDDEPEEVVVKAKIRSKARRIVSDGEDEDDSFKDTSSINPFNTSLFQFSSVKQFDASTPKNDISPPGRFFSSQIPSSVNKSMNSRRSLASRRSLINMVLDHVEDMEERLDDSSEAKGPEDYPEEGVEESSGEASKYTEEDPSGETLSSENKSSWLMTPKPSALAQETSLGAPEPLSGE

SEQ ID NO: 2596 - protein, 474 aa, Homo sapiens [sequence omitted]

SEQ ID NO: 2597 - protein, 127 aa, Homo sapiens
MFYPLDLFRNIPWKQGKCFASLSPEGERAFDGMEPLCQPGARPALRGLQHASDCYRLLSPPGSGLVGTNPSVPAPSPHCGCCRAWSISSFTFTGPTPFKINSDQATPCHLRSPETISRQREISNEAF

SEQ ID NO: 2598 - protein, 261 aa, Homo sapiens
MTCLAPTMSAELNVPIDPSAPACPEPGHKGMDYRDWVRRSYLELVTSNHHSVQALSWRKLYLSRAKLKASSRTSALLSGFAMVAMVEVQLETQYQYPRPLLIAFSACTTVLVAVHLFALLISTCILPNVEAVSNIHNLNSISESPHERMHPYIELAWGFSTVLGILLFLAEVVLLCWIKFLPVDARRQPGPPPGPGSHTGWQAALVSTIIMVPVGLIFVVFTIHFYRSLVRHKTERHNREIEELHKLKVQLDGHERSLQVL

SEQ ID NO: 2599 - protein, 752 aa, Homo sapiens
MAEPASVTVTFDDVALYFSEQEWEILEKWQKQMYKQEMKTNYETLDSLGYAFSKPDLITWMEQGRMLLISEQGCLDKTRRTTSPPTDEQLNMKNTGKLLCFDDEGTPRTKEEDCRLNGPQKQDLCAALRGKERKILLAQTATFQSPSLRETEILNKKVSITAYDPDKKDLRHKPRETPGRLEIPTGPRCYSCYVCRKVFQVRRDLLKHKRSHSKSQLCRYPKYKNSSRGKSELRRTQRLLCQKKRFQCSECEKSYFLKGSLVTHQVVHTGQRPYPCPECDKTFRYRANLKKHLCLHRGERPFCCGECGRAFVQQCELTEHLRLHSGEKPFQCPQCDRCFRLKRGMKVHLAQHSGKRPFHCPECGRSFSRKAALKTHQRTHSEEKPFSCGECGRKFIYKIKLDEHIRVHTGEKPFSCPECNKSFRLKRSLKAHGLQHIGKRPFQCPECSRGFFWRNAMRAHQRLHSEQKPFPCAECGKRFTRPSKLACHTRVHDRQKEFPCGECKKTFSQQSRLTQHLKVHTTEKPFSCAECGRSFRRRAHLTEHTRLHSGEEPFQCPECDKSFSWKASMKFHQRMHRDEKPFACGECDKTYTHQSQLTEHLRLHSGEKPYQCPECEKTFRLKGNLKSHLLQHSGQKPFSCVMCGKSFTQQYRLTEHIRVHSVEKPFQCPECDKSYCIRGSLKVHLYKHSGERPFQCPECGKGFLQKRSLKAHLCLHSGERPFSCDECGRSFTYVGALKTHIAVHAKEKPSSL

SEQ ID NO: 2600 - protein, 831 aa, Homo sapiens
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALGRGTIKLLSRAVMHAVCEQCGLKINGGEVAVFASRAGPGVCWHPSCFVCFTCNELLVDLIYFYQDGKIHCGRHHAELLKPRCSACDEIIFADECTEAEGRHWHMKHFCCLECETVLGGQRYIMKDGRPFCCGCFESLYAEYCETCGEHIGVDHAQMTYDGQHWHATEACFSCAQCKASLLGCPFLPKQGQIYCSKTCSLGEDVHASDSSDSAFQSARSRDSRRSVRMGKSSRSADQCRQSLLLSPALNYKFPGLSGNADDTLSRKLDDLSLSRQGTSFASEEFWKGRVEQETPEDPEEWADHEDYMTQLLLKFGDKSLFQPQPNEMDIRASEHWISDNMVKSKTELKQNNQSLASKKYQSDMYWAQSQDGLGDSAYGSHPGPASSRRLQELELDHGASGYNHDETQWYEDSLECLSDLKPEQSVRDSMDSLALSNITGASVDGENKPRPSLYSLQNFEEMETEDCEKMSNMGTLNSSMLHRSAESLKSLSSELCPEKILPEEKPVHLPVLRRSKSQSRPQQVKFSDDVIDNGNYDIEIRQPPMSERTRRRVYNFEERGSRSHHHRRRRSRKSRSDNALNLVTERKYSPKDRLRLYTPDNYEKFIQNKSAREIQAYIQNADLYGQYAHATPDYGLQNPGMNRFLGLYGEDDDSWCSSSSSSSDSEEEGYFLGQPIPQPRPQRFAYYTDDLSSPPSALPTPQFGQRTTKSKKKKGHKGKNCIIS

SEQ ID NO: 2601 - protein, 210 aa, Homo sapiens [sequence omitted]

SEQ ID NO: 2602 - protein, 106 aa, Homo sapiens
MQREFLLSLFSAREPYRERRKCPRETEKYQNNHRYVRKVAPRHFPKLIIADLLSKVTNTRRALYFHEAENVLYNRQLLRALTVKRSARNRKSSTHFLHELPGELCP

SEQ ID NO: 2603 - protein, 150 aa, Homo sapiens [sequence omitted]

SEQ ID NO: 2604 - protein, 610 aa, Homo sapiens [sequence omitted]

SEQ ID NO: 2605 - protein, 176 aa, Homo sapiens
MLTHSDTHLQTQRLPLAQGRDVGLLSIGFSPDGGPPPPPAGARTYSIMDSAILRMVPLSKLLVHGEGEAIFSKLWDWALLSSMACESSMEKSHTHTLDSNFVSALHRLPRSVFPNTSSSPLSTWPRLPFTNGESPFRELLLWSMDPPHCPVSWKWPPSWLPETRGRSSGAGGGLSS

SEQ ID NO: 2606 - protein, 360 aa, Homo sapiens
MVPAAGRRPPRVMRLLGWWQVLLWVLGLPVRGVEVAEESGRLWSEEQPAHPLQVGAVYLGEEELLHDPMGQDRAAEEANAVLGLGTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 2607 - protein, 691 aa, Homo sapiens
MMRNHRIASSLCGDQVFSKKKKKKKKNNMAAKEKLEAVLNVALRVPSIMLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEPVLQPHAGAEQNVMFQEGTEPPGQEHTPGTRIQEGSRDNNEYIARRPDNQEGAFDPKEYPHSAKDEAHPVESA

SEQ ID NO: 2608 - protein, 579 aa, Homo sapiens
MEANHCSLAPKSWMVREKYIRPLTTEEWVEKMMDADPEFPPDFAEAFESQLSLSDSPSLCRPVYSKKGLEHKADLQQHLFPVPPGHLECTPESLWKELSLQHEGLKELIHKQMRPFSQGIVILSRSWAVDLNLQEKPGVICDALLIAQNSTPILYTILREQDAEGQDYCTRTAFTLKQKLVNMGGYTGKVCVRAKVLCLSPESSAEALEAAVSPMDYPASYSLAGTQHMEALLQSLVIVLLGFRSLLSDQLGCEVLNLLTAQQYEIFSRSLRKNRELFVHGLPGSGKTIMAMKIMEKIRNVFHCEAHRILYVCENQPLRNFISDRNICRAETRETFLREKFEHIQHIVIDEAQNFRTEDGDWYRKAKTITQREKDCPGVLWIFLDYFQTSHLGHSGLPPLSAQYPREELTRVVRNADEIAEYIQQEMQLIIENPPINIPHGYLAILSEAKWVPGVPGNTKIIKNFTLEQIVTYVADTCRCFFERGYSPKDVAVLVSTVTEVEQYQSKLLKAMRKKMVVQLSDACDMLGVHIVLDSVRRFSGLERSIVFGIHPRTADPAILPNILICLASRAKQHLYIFL

SEQ ID NO: 2609 - protein, 1019 aa, Homo sapiens
MEDGGLTAFEEDQRCLSQSLPLPVSAEGPAAQTTAEPSRSFSSAHRHLSRRNGLSRLCQSRTALSEDRWSSYCLSSLAAQNICTSKLHCPAAPEHTDPSEPRGSVSCCSLLRGLSSGWSSPLLPAPVCNPNKAIFTVDAKTTEILVANDKACGLLGYSSQDLIGQKLTQFFLRSDSDVVEALSEEHMEADGHAAVVFGTVVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDK

SEQ ID NO: 2610 - protein, 130 aa, Homo sapiens
MKKRVSWAKRGVQQDGRCVVSQLERSRSKRGNILLFSSPLPSPSANGTCEIWLDFEASNSSLHSQTLLLSLVAALRINLLVTFFNQFLPEKRLGCKDDRNQTSNGFPGAEGRKGFSYSFSSQGIKKRMGS

SEQ ID NO: 2611 - protein, 170 aa, Homo sapiens
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLVPGVSVSGLESKDIFPRFKPFTDAVGMPHFTRITM

SEQ ID NO: 2612 - protein, 163 aa, Homo sapiens
MFLHSGPARGPCTAAGRSASVRVPVQVAHELQGPDAIVFGAEVEQVHLVANELDAGRVQLLLAQGVAAAVLLVQVVMGEELGEQGHQQARGEVADGQAALLDTAKMLVAEQAVGAGQLQVGLGISNLSKSIGTSQIFLERHRSPLKLSSTLITEMSSGRLEEL

SEQ ID NO: 2613 - protein, 119 aa, Homo sapiens
MCCTLAWGPTGCGLDAFPLGGSFLPRSPPLWRGPRRPPVGPPLQTALSLLGCLQPGPAHACPPEKYVAFQKEVGDHGQALWTLTSAPPPVPQGPRPGGPRPAFLGPQVAQWCRGIQTFC

SEQ ID NO: 2614 - protein, 915 aa, Homo sapiens
MSDDIRKRFEFPNSLIQSQAVGHLIAAVLKENGFSEKIHQSTNQTPALNLLWEKCCSDNVVVRTACCEGLVALVAQDHAEFSYVLNGILNLIPSTRNTHGLIKAIMHLLQMQALKEGQGGEKNIQSIYTIRNHPHPLITVLEHRPDCWPVFLQQLTAFFQQCPERLEVSCIQIMAPFLWYLYCEPSQLQEYAKLRLALLKVLLQPQVLCDKDQPSILEQQILQLCCDIVPCLQVKDLIQTTEAMMFIEEVCLSLLRHPVFWKIQLTQMSLQLLCVSEVSLKITGECSSSIHLLEHSVELLKEDFPVELVIIGIALLLLQTPASQQKPILNLALKLLSVTEDQKIPKSSLLLVMPILQILSSTALEDCISVDEEGPSRQQLALNLLEMIQQECYRDDHQKLSYKLVCPVTSMYGTIFTAWRILEVMTDSSAASDWLASVESLLPITAVIPAPAFLLLAHLLVEDKGQNLHQILKVTTELAQVDSSQVPNLIPVLMFKLGRPLEPILYNDILYTLPKLGVHKVCIGQILRIIQLLGTTPRLRAVTLRLLTSLWEKQDRVYPELQRFMAVSDVPSLSVGKEVQWEKLIAKAASIRDICKQRPYQHGADMLAAISQVLNECTKPDQATPAALVLQGLHALCQAEVVCIRSTWNALSPKLSCDTRPLILKTLSELFSLVPSLTVNTTEYENFKVQVLSFLWTHTQNKDPIVANAAYRSLANFSAGEHTILHLPEKIRPEIPIPEELDDDEDVEDVDLSVPGSCYLKLLSLTPPLVLPALEEFFTSLVKQEMVNMPRGIYHSALKGGARSDQGKTVAGIPNFILKMYETNKQPGLKPGLAGGMLFCYDVSMYQSKDGKPLNRLMASRGRSFKQTSLALVHEVHIQLSEWHRAIFLPQAWLAYMNRAYHAILQGRLGELELQ

SEQ ID NO: 2615 - protein, 485 aa, Homo sapiens [sequence omitted]

SEQ ID NO: 2616 - protein, 711 aa, Homo sapiens
MSSVQSQQEQLSQSDPSPSPNSCSSFELIDMDAGSLYEPVSPHWFYCKIIDSKETWIPFNSEDSQQLEEAYSSGKGCNGRVVPTDGGRYDVHLGERMRYAVYWDELASEVRRCTWFYKGDKDNKYVPYSESSSQVLEETYMLAVTLDEWKKKLESPNREIIILHNPKLMVHYQPVAGSDGWGSTPTEQGRPRTVKRGVENISVDIHCGEPLQIDHLVFVVHGIGPACDLRFRSIVQCVNDFRSVSLNLLQTHFKKAQENQQIGRVEFLPVNWHSPLHSTGVDVDLQRITLPSINRLRHFTNDTILDVFFYNSPTYCQTIVDTVASEMNRIYTLFLQRNPDFKGGVSIAGHSLGSLILFDILTNQKDSLGDIDSEKDSLNIVMYQGDTPTLEEDLKKLQLSEFFDIFEKEKVDKEALALCTDRDLQEIGIPLGPRKKILNYFSTRKNSMGIKRPAPQPASGANIPKESEFCSSSNTRNGDYLDVGIGQVSVKYPRLIYKPEIFFAFGSPIGMFLTVRGLKRIDPNYRFPTCKGFFNIYHPFDPVAYRIEPMVVPGVEFEPMLIPHHKGRKRMHLELREGLTRMSMDLKNNLLGSLRMAWKSFTRAPYPALQASETPEETEAEPESTSEKPSDVNTEETSVAVKEEVLPINVGMLNGGQRIDYVLQEKPIESFNEYLFALQSHLCYWESEDTVLLVLKEIYQTQGIFLDQPLQ

SEQ ID NO: 2617 - protein, 547 aa, Homo sapiens
MAMGLFRVCLVVVTAIINHPLLFPRENATVPENEEEIIRKMQAHQEKLQLEQLRLEEEVARLAAEKEALEQVAEEGRQQNETRVAWDLWSTLCMILFLMIEVWRQDHQEGPSPECLGGEEDELPGLGGAPLQGLTLPNKATLGHFYERCIRGATADAARTREFLEGFVDDLLEALRSLCNRDTDMEVEDFIGVDSMYENWQVDRPLLCHLFVPFTPPEPYRFHPELWCSGRSVPLDRQGYGQIKVVRADGDTLSCICGKTKLGEDMLCLLHGRNSMAPPCGDMENLLCATDSLYLDTMQVMKWFQTALTRAWKGIAHKYEFDLAFGQLDSPGSLKIKFRSGKFMPFNLIPVIQCDDSDLYFVSHLPREPSEGTPASSTDWLLSFAVYERHFLRTTLKALPEGACHLSCLQIASFLLSKQSRLTGPSGLSSYHLKTALLHLLLLRQAADWKAGQLDARLHELLCFLEKSLLQKKLHHFFIGNRKVPEAMGLPEAVLRAEPLNLFRPFVLQRSLYRKTLDSFYEMLKNAPALISEYSLHVPSDQPTPKS

SEQ ID NO: 2618 - protein, 775 aa, Homo sapiens
MGLLLLSVVVTSRPEAFQPHHRELLRLLNETLGEVGSPGLLFYSLRTLTTMAPYLSTEDVPLARMLVPKLIMAMQTLIPIDEAKACEALEALDELLESEVPVITPYLSEVLTFCLEVARNVALGNAIRIRILCCLTFLVKVKSKALLKNRLLPPLLHTLFPIVAAEPPPGQLDPEDQDSEEEELEIELMGETPKHFAVQVVDMLALHLPPEKLCPQLMPMLEEALRSESPYQRKAGLLVLAVLSDGAGDHIRQRLLPPLLQIVCKGLEDPSQVVRNAALFALGQFSENLQPHISSYSREVMPLLLAYLKSVPLGHTHHLAKACYALENFVENLGPKVQPYLPELMECMLQLLRNPSSPRAKELAVSALGAIATAAQASLLPYFPAIMEHLREFLLTGREDLQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGGISVNTSVAFLPYMESVFEEVFKLLECPHLNVRKAAHEALGQFCCALHKACQSCPSEPNTAALQAALARVVPSYMQAVNRERERQVVMAVLEALTGVLRSCGTLTLKPPGRLAELCGVLKAVLQRKTACQDTDEEEKEEDDDQPLTWLHRLNTTPCCWSTLERPSLPWQPRLGETPLPHSLPVSCHYWCARQNRAAQWQRSPLQWGPWQRLFRAWVLPQPSLCLGCSLCC

SEQ ID NO: 2619 - protein, 963 aa, Homo sapiens [sequence omitted]

SEQ ID NO: 2620 - protein, 104 aa, Homo sapiens
MRRALRGLGWPARSGEGVHEAKGLKISPFQEAPRGSASICHRCTNISAEFSVDSQTSHPAERRITTGVISEQRLCRPAGRRASTVACDRCGNLERPMRGSRTRG

SEQ ID NO: 2621 - protein, 637 aa, Homo sapiens
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 2622 - protein, 423 aa, Homo sapiens [sequence omitted]

SEQ ID NO: 2623 - protein, 865 aa, Homo sapiens [sequence omitted]

SEQ ID NO: 2624 - protein, 157 aa, Homo sapiens
MELPQSRFSWKQRKAQLPGRRHNASYCLCHFPSSLPAFLRLLGSHCPVQELFADAQPRLPKLPREVVSVHSHCFQTSRANWGGEARPRESSKRPSLQHRPPAAGVGSWVAGGQLVPALLDMSRVGAEARVALIHNEAPGRGSRGPRSLEEDRGWIIQ

SEQ ID NO: 2625 - protein, 162 aa, Homo sapiens
MVHKPSGQIMAVKRIRSTVNEKEQKQPLTDLDEVMQSSDCPYIVQFYDALYRQGDCWTCMELMSISFDKFYKYVYSVLDDVIPEEILGRITLASVKALNHLKENLKIIHRDIKPSNILLDRSENIKLCDFGISGQLVDSIAKTEDAGCRPYMAPERIDPSAS

SEQ ID NO: 2626 - protein, 995 aa, Homo sapiens
MSSLPRRAKVQVQDVVLKDEFSSFSELSSASEEDDKEDSAWEPQKKVPRSRKQPPPKESKPKRMPRVKKNAPQISDGSEVVVVKEELNSSVAIADTALEDRKNKLDTVQTLKTAKTKQKCAAQPHTVRRTKKLKVEEETSKASNLEGESNSSETPSTSTVWGGTCKKEENDDDFTFGQSALKKIKTETYPQGQPVKFPANANSTKEEVEMNWDMVQVLSERTNIEPWVCANIIRLFNDDNTIPFIIRYRKELINNLDADSLREVQQTLEELRAVAKKVHSTIQKIKKEGKMSECLLKAMLNCKTFEELEHVSAPYKTGSKGTKAQRARQLGLEGAARALLEKPGELSLLSYIRPDVKGLSTLQDIEIGVQHILADMIAKDKDTLDFIRNLCQKRHVCIQSSLAKVSSKKVNEKDVDKFLLYQHFSCNIRNIHHHQILAINRGENLKVLTVKVNISDGVKDEFCRWCIQNRWRPRSFARPELMKILYNSLNDSFKRLIYPLLCREFRAKLTSDAEKESVMMFGRNLRQLLLTSPVPGRTLMGVDPGYKHGCKLAIISPTSQILHTDVVYLHCGQGFREAEKIKTLLLNFNCSTVVIGNGTACRETEAYFADLIMKNYFAPLDVVYCIVSEAGASIYSVGPEANKEMPGLDPNLRSAVSIARRVQDPLAELVKIEPKHIGVGMYQHDVSQTLLKATLDSVVEECVSFVGVDINICSEVLLRHIAGLNANRAKNIIEWREKNGPFINREQLKKVKGLGPKSFQQCAGFIRINQDYIRTFCSQQTETSGQIQGVAVTSSADVEVTNEKQGKKKSKTAVNVLLKPNPLDQTCIHPESYDIAMRFLSSIGGTLYEVGKPEMQQKINSFLEKEGMEKIAERLQTTVHTLQVIIDGLSQPESFDFRTDFDKPDFKRSIVCLEDLQIGTVLTGKVENATLFGIFVDIGVGKSGLIPIRNVTEAKLSKTKKRRSLGLGPGERVEVQVLNIDIPRSRITLDLIRVL

SEQ ID NO: 2627 - protein, 1287 aa, Homo sapiens
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQMEGLQEDSILCLPAAYCERAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQ

SEQ ID NO: 2628 - protein, 266 aa, Homo sapiens
MRLLFLAVLRPHTGNAVTAQRVRAHLEAAGHVCVLKDAFDFESRSEIANLILAENCEAALALHLYRGGRLLQGHRIPFGVIFGGTDVNEDANQAEKNTVMGRVLEEARFAVAFTESMKEMAQAQWVDPVFTREVKAKVKRAAGVRLIGEMPQEDLHAVVKNCFAVVNSSVSEGMSAAILEAMDLEVPVLARNIPGNAAVVKHEVTGLLFSNPQEFVHLAKRLVSDPALEKEIVVNGREYVRMYHSWQVERDTYQQLIRKLEGSTED

SEQ ID NO: 2629 - protein, 1047 aa, Homo sapiens
MKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKRNTHDSEMLGLRRLSSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKRAEKSEDSSGAAGLSGLHRTYSQDCSFKNSMYHVGDHVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNL

SEQ ID NO: 2630 - protein, 450 aa, Homo sapiens [sequence omitted]

SEQ ID NO: 2631 - protein, 1034 aa, Homo sapiens [sequence omitted]

SEQ ID NO: 2632 - protein, 577 aa, Homo sapiens
MKKGTIVKKLLLTVDTTDDNFMPKRVVVYGGEGDNLKKLSDVSIDETLIGDVCVLEDMTVHLPIIEIRIVECRDDGIDVRLRGVKIKSSRQRELGLNADLFQPTSLVRYPRLEGTDPEVLYRRAVLLQRFIKILDSVLHHLVPAWDHTLGTFSEIKQVKQFLLLSRQRPGLVAQCLRDSESSKPSFMPRLYINRRLAMEHRACPSRDPACKNAVFTQVYEGLKPSDKYEKPLDYRWPMRYDQWWECKFIAEGIIDQGGGFRDSLADMSEELCPSSADTPVPLPFFVRTANQGNGTGEARDMYVPNPSCRDFAKYEWIGQLMGAALRGKEFLVLALPGFVWKQLSGEEVSWSKDFPAVDSVLVKLLEVMEGMDKETFEFKFGKELTFTTVLSDQQVVELIPGGAGIVVGYGDRSRFIQLVQKARLEESKEQVAAMQAGLLKVVPQAVLDLLTWQELEKKVCGDPEVTVDALRKLTRFEDFEPSDSRVQYFWEALNNFTNEDRSRFLRFVTGRSRLPARIYIYPDKLGYETTDALPESSTCSSTLFLPHYASAKVCEEKLRYAAYNCVAIDTDMSPWEE

SEQ ID NO: 2633 - protein, 134 aa, Homo sapiens [sequence omitted]

SEQ ID NO: 2634 - protein, 790 aa, Homo sapiens
MAYCLTNCYQYSVTFEDTAVDFTQEEWILLDPVQRNLYRDVMLENYENVAKVGFQLFKPSVISWLEEEELRTLQQGVLQDWAIKHQTSVSALQQEFWKIQTSNGIQMDLVTFDSVAVEFTQEEWTLLDPAQRNLYSDVMLENYKNLSSVGYQLFKPSLISWLEEEEELSTLPRVLQEWKMCLKTKGPALWQDNFCLKTLNGIQLARNQNGEELYDCKQCEDVFCKHPCLKTNMSTQNRGNTSECIQYAKDLLSLYNKTSTIRKVSVFSKHGKSFRLILNVQVQRKCTQDKSFEGTDYGKAFIYQSYLEAHRKTQSGEKLNEWKQCGEAFTHSTSHAVNVETHIIKNPYECKECGKDFRYPTHLNNHMQTHIGIKPYKCKHCGKTFTVPSGFLEHVRTHTGEKPYGCKECGKAFGTSAGLIEHIRCHAREKTFKCDHCGKAFISYPSLFGHLRVHNGEKPYEHKEYGKAFGTSSGIIEDRRSNTGQKRFDCDQCGKVFVSFSSLFAHLRTHTGEKPFKCYKCGKPFTSSACLRIHMRTHTEERLYQCKKCGKAFTKCSYLTKHLRTHAGEKPYECMKCGKAFTERSYLTKHLRRHSGEKPYECKKCGKAFTERSDLTKHLRRHTGDKPYEYKDCGKAFVVSSSLVDHLRTHTGYKPYKCNACEKAYSRSCVLTQHLKTHAAEKTSECNACGNSFRNSMCFHDRLKTLTKIKPYKCKDCGKAFTCHSDLTNHVRIHTGEKPYKCKECGKAFRTSSGRIQHLRTHMGEKPFECDQCGKAFASFSARIAHLKTH

SEQ ID NO: 2635 - protein, 490 aa, Homo sapiens
MVGKPVHKGSESPNSFLDQEYRKRFNIVEEDTVLYCYEYEKGRSSSQGRRESTPTYENSLLRYMSNEKIAQEEYMFQRNSKKDTGKKSKKKGDKSNSPTHYSLLPSLQMDALRQDIMGTPVPETTLYHTFQQSSLQHKSKKKNKGPIAGKSKRRISCKDLGRGDCEGWLWKKKDAKSYFSQKWKKYWFVLKDASLYWYINEEDEKAEGFISLPEFKIDRASECRKKYAFKACHPKIKSFYFAAEHLDDMNRWLNRINMLTAGYAERERIKQEQDYWSESDKEEADTPSTPKQDSPPPPYDTYPRPPSMSCASPYVEAKHSRLSSTETSQSQSSHEEFRQEVTGSSAVSPIRKTASQRRSWQDLIETPLTSSGLHYLQTLPLEDSVFSDSAAISPEHRRQSTLPTQKCHLQDHYGPYPLAESERMQVLNGNGGKPRSFTLPRDSGFNHCCLNAPVSACDPQDDVQPPEVEEEEEEEEEEGEAAGENIGEKS

SEQ ID NO: 2636 - protein, 781 aa, Homo sapiens [sequence omitted]

SEQ ID NO: 2637 - protein, 395 aa, Homo sapiens
MHTGEKPYKCHECGKLFSSNSNLSQHQRIHTGEKPYKCHECDKVFRSSSKLAQHQRIHTGEKPYKCHECDKVFNQIAHLVRHQKIHTGEKPYSCNKCGKVFSRHSYLAEHQTVHTGEKPYKCEECGKAFSVRSSLITHQLIHTGRKPYKCKECDKVFGRKCFLTSHQRIHTRERPYGCSQCGKIFSQKSDLIRHRKTHTDEKPYKCNKCGTAFREFSDLTAHFLIHSGEKPYECKECGKVFRYKSSLTSHHRIHTGEKPYKCNRCGKVFSRSSNLVCHQKIHTGEKPYKCNQCGKVFNQASYLTRHQIIHTGERPYRCSKCGKAFRGCSGLTAHLAIHTEKKSHECKECGKIFTQKSSLTNHHRIHIGEKPYKCTLCSKVFSHNSDLAQHQRVHS

SEQ ID NO: 2638 - protein, 248 aa, Homo sapiens
MNFTHICRSHNSINQSLDESVIYGPGNLSTNNNTLRDHFKGISSHSRSSLMPLRNDVDKRGETTSASLLNAGLSHTEYQIVTDPGDVPAFLKWLSLASLLVYVAAFSIGLGPMPWLVLSEIFPGGIRGRAMALTSSMNWGINLLISLTFLTVTDLIGLPWVCFIYTIMSLASLLFVVMFIPETKGCSLEQISMELAKVNYVKNNICFMSHHQEELVPKQPQKRKPQEQLLECNKLCGRGQSRQLSPET

SEQ ID NO: 2639 - protein, 184 aa, Homo sapiens
MPVKGASSLLFLPLPPSAWQLCLLSKRRVHPIRTPLPFHSWIKALVISNQKVPERERPEGTGVLSDGCLGQSQEGEPLLSPPALAHFPLHARCCGSSWAWPGSAGEAIRMVSGAPFLCFLDGLDGLPCSSPMAALPAPMAALPARRQRQEHIEGGSQGCGVRSPAPCRGKPGSATSSTLRLCPA

SEQ ID NO: 2640 - protein, 158 aa, Homo sapiens
MYTASSSAETLRTVRRRSVPSSSMPYLALAHNRVSSLNHAASVDGWGTSHRNVADSFSRTSRSCSRFLKGTAGSARREDWNGHLQPWIPRPDRRGWETADRKGERTQVHGLRRSLGPRAPHPGAHRALRPAQSCRSGPRGWTPCRCRGRGPTACRRGS

SEQ ID NO: 2641 - protein, 1251 aa, Homo sapiens
MLLQNPYITVRSDGSLHIERVQLQDGGEYTCVASNVAGTNNKTTSVVVHVLPTIQHGQQILSTIEGIPVTLPCKASGNPKPSVIWSKKGELISTSSAKFSAGADGSLYVVSPGGEESGEYVCTATNTAGYAKRKVQLTVYVRPRVFGDQRGLSQDKPVEISVLAGEEVTLPCEVKSLPPPIITWAKETQLISPFSPRHTFLPSGSMKITETRTSDSGMYLCVAINIAGNVTQAVKLNVHVPPKIQRGPKHLKVQVGQRVDIPCNAQGTPLPVITWSKGGSTMLVDGEHHVSNPDGTLSIDQATPSDAGIYTCVATNIAGTDETEITLHVQEPPTVEDLEPPYNTTFQERVANQRIEFPCPAKGTPKPTIKWLHNGRELTGREPGISILEDGTLLVIASVTPYDNGEYICVAVNEAGTTERKYNLKVHVPPVIKDKEQVTNVSVLLNQLTNLFCEVEGTPSPIIMWYKDNVQVTESSTIQTVNNGRILKLFRATPEDAGRYSCKAINIAGTSQKYFNIDVLVPPTIIGTNFPNEVSVVLNRDVALECQVKGTPFPDIHWFKDGKPLFLGDPNVELLDRGQVLHLKNARRNDKGRYQCTVSNAAGKQAKDIKLTIYIPPSIKGGNVTTDISVLINSLIKLECETRGLPMPAITWYKDGQPIMSSSQALYIDKGQYLHIPRAQVSDSATYTCHVANVAGTAEKSFHVDVYVPPMIEGNLATPLNKQVVIAHSLTLECKAAGNPSPILTWLKDGVPVKANDNIRIEAGGKKLEIMSAQEIDRGQYICVATSVAGEKEIKYEVDVLVPPAIEGGDETSYFIVMVNNLLELDCHVTGSPPPTIMWLKDGQLVDERDGFKILLNGRKLVIAQAQVSNTGLYRCMAANTAGDHKEEFEVTVHVPPTIKSSGLSERVVVKYKPVALQCIANGIPNPSITWLKDDQPVNTAQGNLKIQSSGRVLQIAKTLLEDAGRYTCVATNAAGETQQHIQLHVHEPPSLEDAGKMLNETVLVSNPVQLECKAAGNPVPVITWYKDNRLLSGSTSMTFLNRGQIIDIESAQISDAGIYKCVAINSAGATELFYSLQVHVAPSISGSNNMVAVVVNNPVRLECEARGIPAPSLTWLKDGSPVSSFSNGLQVLSGGRILALTSAQISDTGRYTCVAVNAAGEKQRDIDLRVYVPPNIMGEEQNVSVLISQAVELLCQSDAIPPPTLTWLKDGHPLLKKPGLSISENRSVLKIEDAQVQDTGRYTCEATNVA

SEQ ID NO: 2642 - protein, 702 aa, Homo sapiens [sequence omitted]

SEQ ID NO: 2643 - protein, 816 aa, Homo sapiens [sequence omitted]

SEQ ID NO: 2644 - protein, 112 aa, Homo sapiens
MTDLASGPQAFPVAVFMTLLRSSNSSHVWNHSLPDRRISWPQLMICTKPNLFWGTHQASGLTFSALLSLPICPGFLLVSTTGHLSEAGSPPGSCGLLPRAWREAAPTLEDDS

SEQ ID NO: 2645 - protein, 698 aa, Homo sapiens
MSAVVAQTLHVFGLRSHVANNIFYFDEQIIIFPSGNHCVKYNVDQKWQKFIPGSEKSQGMLALSISPNRRYLAISETVQEKPAITIYELSSIPCRKRKVLNNFDFQVQKFISMAFSPDSKYLLAQTSPPESNLVYWLWEKQKVMAIVRIDTQNNPVYQVSFSPQDNTQVCVTGNGMFKLLRFAEGTLKQTSFQRGEPQNYLAHTWVADDKIVVGTDTGKLFLFESGDQRWETSIMVKEPTNGSKSLDVIQESESLIEFPPVSSPLPSYEQMVAASSHSQMSMPQVFAIAAYSKGFACSAGPGRVLLFEKMEEKDFYRESREIRIPVDPQSNDPSQSDKQDVLCLCFSPSEETLVASTSKNQLYSITMSLTEISKGEPAHFEYLMYPLHSAPITGLATCIRKPLIATCSLDRSIRLWNYETNTLELFKEYQEEAYSISLHPSGHFIVVGFADKLRLMNLLIDDIRSFKEYSVRGCGECSFSNGGHLFAAVNGNVIHVYTTTSLENISSLKGHTGKIRSIVWNADDSKLISGGTDGAVYEWNLSTGKRETECVLKSCSYNCVTVSPDAKIIFAVGSDHTLKEIADSLILREISAFDVTYTAIVISHSGRMMFVGTSVGTIRAMKYPLPLQKEFNEYQAHAGPITKVSRTLSPGTQSHTCLLRALFIPSTSQCLFSLLLLSYLFIHHSLNHHLLTMNILFV

SEQ ID NO: 2646 - protein, 725 aa, Homo sapiens
MDDSDTPTYYLQIEPQDGCHPGDSVERSVTCLPSASDENENQLDGDGHEHLTSSDSAMGKPQVSEQDSLNNNESCTLSCEVAAGENSQNTLCEASRDEQAFLGKDKKIPGKRSPRSKKGTAKKIPPGLFSGDIAPLMQEKVLSAVTYAVDDEEAAEVNANEQPEAPKLVLQSLFSLIRGEVEQLDSRALPLCLHQIAESYFQEEDYEKAMKFIQLERLYHEQLLANLSAIQEQWETKWKTVQPHTVTALRNSEKGFNGEDFERLTKICATHQDPLLSKHKIAAVEKSQERKCSTQLLVSEDPKEGGATTKESESKTCLGTESSKESQHTVEPLGSSPCCHQMDVQTDSPSLSVTAGKDHMEELLCSAEATLALHTQSSETAGSPSGPDSSEDACEDDSRLQLAQTEACQDVARIEGIAEDPKVFLSSKSKTEPLISPGCDRIPPALISEGKYSQAQRKELRLPLRDASEALPTDQLENNELNELQQPDLTDSDGKSPQAQADSDGSENVLCGNNQISDLGILLPEVCMAPEEKGDKDDQLNKETEDYLNSLLEGCLKDTEDSLSYEDNQDDDSDLLQDLSPEEASYSLQENLPSDESCLSLDDLAKRIEIAEVVPTEGLVSILKKRNDTVGDHPAQMQHKPSKRRVRFQEIDDSLDQDEVGGGSCILLVLLCIATVFLSVGGTALYCTFGDMESPVCTDFADNMDFYYTKLLQGVAELKHWIYLS

SEQ ID NO: 2647 - protein, 924 aa, Homo sapiens [sequence omitted]

SEQ ID NO: 2648 - protein, 291 aa, Homo sapiens [sequence omitted]

SEQ ID NO: 2649 - protein, 113 aa, Homo sapiens
MLRIAFFFFFFFFFLTQSLALSPRLECSGAILAHCNLCLPGSSNSPASASQVAGITGMCHHAGLIFVFLVETVFHHVGQAVLELLASSDPPTLASQSAGITGVSPRAQQGLLF

SEQ ID NO: 2650 - protein, 105 aa, Homo sapiens
MPSSSCTSAAPPPSVRSSRGCSRSSWLWTIPRSLHFLSGYTRTDKVGERVNPTRPFPSYLCPSPPTKTPAGLGWELWASPEHQGSSCPCGVQICGIRAGRQEQSP

SEQ ID NO: 2651 - protein, 1203 aa, Homo sapiens [sequence omitted]

SEQ ID NO: 2652 - protein, 955 aa, Homo sapiens
MWAGLLLRAACVALLLPGAPARGYTGRKPPGHFAAERRRLGPHVCLSGFGSGCCPGWAPSMGGGHCTLPLCSFGCGSGICIAPNVCSCQDGEQGATCPETHGPCGEYGCDLTCNHGGCQEVARVCPVGFSMTEAAVGIRCTDIDECVTSSCEGHCVNTEGGFVCECGPGMQLSADRHSCQDTDECLGTPCQQRCKNSIGSYKCSCRTGFHLHGNRHSCVDVNECRRPLERRVCHHSCHNTVGSFLCTCRPGFRLRADRVSCEAFPKAVLAPSAILQPRQHPSKMLLLLPEAGRPALSPGHSPPSGAPGPPAGVRTTRLPSPTPRLPTSSPSAPVWLLSTLLATPVPTASLLGNLRPPSLLQGEVMGTPSSPRGPESPRLAAGPSPCWHLGAMHESRSRWTEPGCSQCWCEDGKVTCEKVRCEAACSHPIPSRDGGCCPSCTGCFHSGVVRAEGDVFSPPNENCTVCVCLAGNVSCISPECPSGPCQTPPQTDCCTCVPVRCYFHGRWYADGAVFSGGGDECTTCVCQNGEVECSFMPCPELACPREEWRLGPGQCCFTCQEPTPSTGCSLDDNGVEFPIGQIWSPGDPCELCICQADGSVSCKRTDCVDSCPHPIRIPGQCCPDCSAGCTYTGRIFYNNETFPSVLDPCLSCICLLGSVACSPVDCPITCTYPFHPDGECCPVCRDCNYEGRKVANGQVFTLDDEPCTRCTCQLGEVSCEKVPCQRACADPALLPGDCCSSCPDSLSPLEEKQGLSPHGNVAFSKAGRSLHGDTEAPVNCSSCPGPPTASPSRPVLHLLQLLLRTNLMKTQTLPTSPAGAHGPHSLALGLTATFPGEPGASPRLSPGPSTPPGAPTLPLASPGAPQPPPVTPERSFSASGAQIVSRWPPLPGTLLTEASALSMMDPSPSKTPITLLGPRVLSPTTSRLSTALAATTHPGPQQPPVGASRGEESTM

SEQ ID NO: 2653 - protein, 105 aa, Homo sapiens
MWKAQRWHRGKLLTSTQPPHRPYQTGMWEPRCGARFDKWGCSPASARQAATGASGGEAVPAGWLAHSADRLPGKQGKSWLHHIFGKSLTLFLFLTAHAFSTGFDT

SEQ ID NO: 2654 - protein, 136 aa, Homo sapiens
MLRQSLSGCPCPALPSCLLPLCQCPPGLGDPDRRQARPCRPQSGWEQCLEWGLLHSPGQASPKWIPLVWAGTWSKVPPDAPTGFPCFRLLPWPFFLDCSSALLPVQSTDLFLWNLGSKALTMTRMPQSLALTRLQK

SEQ ID NO: 2655 - protein, 804 aa, Homo sapiens [sequence omitted]

SEQ ID NO: 2656 - protein, 472 aa, Homo sapiens
MALGLEQAEEQRLYQQTLLQDGLKDMLDHGKFLDCVVRAGEREFPCHRLVLAACSPYFRARFLAEPERAGELHLEEVSPDVVAQVLHYLYTSEIALDEASVQDLFAAAHRFQIPSIFTICVSFLQKRLCLSNCLAVFRLGLLLDCARLAVAARDFICAHFTLVARDADFLGLSADELIAIISSDGLNVEKEEAVFEAVMRWAGSGDAEAQAERQRALPTVFESVRCRLLPRAFLESRVERHPLVRAQPELLRKVQMVKDAHEGRITTLRKKKKGKDGAGAKEADKGTSKAKAEEDEEAERILPGILNDTLRFGMFLQDLIFMISEEGAVAYDPAANECYCASLSSQVPKNHVSLVTKENQVFVAGGLFYNEDNKEDPMSAYFLQFDHLDSEWLGMPPLPSPRCLFGLGEALNSIYVVGGREIKDGERCLDSVMCYDRLSFKWGHRHRADQFCRSVQHHRQQVGTLRGLPTGA

SEQ ID NO: 2657 - protein, 375 aa, Homo sapiens
MKLVWPSAKLLQAAAGASARACDSVTSNVLPLLLEQFHKHSQSSQRRTILEMLLGFLKLQQKWSYEDKDQRPLNGFKDQLCSLVFMALTDPSTQLQLVGIRTLTVLGAQPDLLSYEDLELAVGHLYRLSFLKEDSQSCRVAALEASGTLAALYPVAFSSHLVPKLAEELRVGESNLTNGDEPTQCSRHLCCLQALSAVSTHPSIVKETLPLLLQHLWQVNRGNMVAQSSDVIAVCQSLRQMAEKCQQDPESCWYFHQTAIPCLLALAVQASMPEKEPSVLRKVLLEDEVLAAMVSVIGTATTHLSPELAAQSVTHIVPLFLDGNVSFLPENSFPSRFQPFQVTDGSSGQRRLIALLMAFVCSLPRNGSSWMNSYS

SEQ ID NO: 2658 - protein, 549 aa, Homo sapiens
MENNLEKVKEEITHIKTQAEDMLVSYENIIQTAMMSSKTGKPGNKPTSLDETSSKVSNVHVSNNKNSEQKENKIAKEKTVQHQVAAHHEATVRSHVKTHQEIKLDDSNIPPPSLKTRPPSPTFITIESTARRTENPTKNELSQSPKKDSYVEPPPRRPMSQKSEIHRANTSPSPPRSRSEQLVRLKDTTAKLSKGAIPCPAATPVPIVEKRSEIIMSPATLRRQIKIETRGRDSPPTITIPVNINHAASGSFRESVDAQEEIRKVEKRATYVHKDGLNSTDHMVPDTESYDAVEIIRKVAVPPRLSEHTQRYEAANRTVQMAENFVNDPENEINRWFREFEHGPVSEAKSNRRVYAKGETNHNIQQESRTFCKEEFGLTSLGNTSFTDFSCKHPRELREKIPVKQPRICSETRSLSEHFSGMDAFESQIVESKMKTSSSHSSEAGKSGCDFKLAPPTYEDVIAGHILDISDSPKEVRKNFQKTWQESGRVFKGLGYATADASATEMRTTFQEESAFISEAAAPRQGNMYTLSKDSLSNGVPSGRQAEFS

SEQ ID NO: 2659 - protein, 538 aa, Homo sapiens [sequence omitted]

SEQ ID NO: 2660 - protein, 293 aa, Homo sapiens
MAATDPCQWPHAQLARSPKESPAKALLRSEPHLNTPAFSLVEDTNGNQVERKSFNPWGLQCHQAHLTRLCSEYPENKRHRFLLLENVVSQYTHPCVLDLKMGTRQHGDDASEEKKARHMRKCAQSTSACLGVRICGMQVYQTDKKYFLCKDKYYGRKLSVEGFRQALYQFLHNGSHLRRELLEPILLQLRALLSIIRSQSSYRFYSSSLLVIYDGQEPPERAPGSPHPHEAPQAAHGSSPGGLTKVDIRMIDFAHTTYKGYWNEHTTYDGPDPGYIFGLENLIRILQDIQEGE

SEQ ID NO: 2661 - protein, 397 aa, Homo sapiens [sequence omitted]

SEQ ID NO: 2662 - protein, 439 aa, Homo sapiens
MPVIDNVFSLAPYRDYLDVPAPEATTEPDSATAEPDSAPATSEGQDKGCRGTLPAQEGPSGSKPLRGSLKEEVALDLSVRKPTAEASPVKASRSVEHAKPTAAMDVPDVGNMVSDLPGLKKIDTEAPGLPGVPVTTDAMPRTNFHSSVAFMFRKFKILRPAPLPAAVVPSTPTSAPAPTQPAPTPTSGPIGLRILAQQPLSVTCFSLALPSPPAVAVASPAPAPAPSPAPARAQAPASARDPAPAPAPVAGPAPASTSAPGDSLEQHFTGLHASLCDAISGSVAHSPPEKLREWLETAGPWGQAAWQDCQGVQGLLAKLLSQLQRFDRTHRCPFPHVVRAGAIFVPIHQVKERLFPRLPPASVDHVLQEHRVELRPTTLSEERALRELALPGCTSRMLKLLALRQLPDIYPDLLGLQWRDCVRRQLGEHGAAPVATGAV

SEQ ID NO: 2663 - protein, 183 aa, Homo sapiens
MQAPRAALVFALVIALVPVGRGNYEELENSGDTTVESERPNKVTIPSTFAAVTIKETLNANINSTNFAPDENQLEFILMVLIPLILLVLLLLSVVFLATYYKRKRTKQEPSSQGSQSALQTYELGSENVKVPIFEEDTPSVMEIEMEELDKWMNSMNRNADFECLPTLKEEKESNHNPSDSES

SEQ ID NO: 2664 - protein, 622 aa, Homo sapiens
MAENTEGDLNSNLLHAPYHTGDPQLDTAIGQWLRWDKNPKTKEQIENLLRNGMNKELRDRLCCRMTFGAAGLRSAMGAGFCYINDLTVIQSTQGMYKYLERCFSDFKQRGFVVGYDTRGQVTSSCSSQRLAKLTAAVLLAKDVPVYLFSRYVPTPFVPYAVQKLKAVAGVMITASHNRKEDNGYKVYWETGAQITSPHDKEILKCIEECVEPWNGSWNDNLVDTSPLKRDPLQDICRRYMEDLKKICFYRELNSKTTLKFVHTSFHGVGHDYVQLAFKVFGFKPPIPVPEQKDPDPDFSTVKCPNPEEGESVLELSLRLAEKENARVVLATDPDADRLAAAELQENGCWKVFTGNELAALFGWWMFDCWKKNKSRNADVKNVYMLATTVSSKILKAIALKEGFHFEETLPGFKWIGSRIIDLLENGKEVLFAFEESIGFLCGTSVLDKDGVSAAVVVAEMASYLETMNITLKQQLVKVYEKYGYHISKTSYFLCYEPPTIKSIFERLRNFDSPKEYPKFCGTFAILHVRDITTGYDSSQPNKKSVLPVSKNSQMITFTFQNGCVATLRTSGTEPKIKYYAEMCASPDQSDTALLEEELKKLIDALIENFLQPSKNGLIWRSV

SEQ ID NO: 2665 - protein, 839 aa, Homo sapiens [sequence omitted]

SEQ ID NO: 2666 - protein, 224 aa, Homo sapiens
MRIHKRGKPYQSSNYSIDFKHSTSLTQDESTLTEVKSYHCNDCGEDFSHITDFTDHQRIHTAENPYDCEQAFSQQAISHPGEKPYQCNVCGKAFKRSTSFIEHHRIHTGEKPYECNECGEAFSRRSSLTQHERTHTGEKPYECIDCGKAFSQSSSLIQHERTHTGEKPYECNECGRAFRKKTNLHDHQRIHTGEKPYSCKECGKNFSRSSALTKHQRIHTRNKL

SEQ ID NO: 2667 - protein, 644 aa, Homo sapiens
MKKPSTSGQNFHSDVDYRGPKNPSKPIKAPSALPPRLQHPSGVRQHAFSSHSSGSQSQKFSSEHKNLSRTPSQIIRKPDRERVEDFDHTSRESNYFGLSPEERREKQAIEESRLLYEIQNRDEQAFPALSSSSVNQSASQSSNPCVQRKSSHVGDRKGSRRRMDTEERKDKDSIHGHSQLDKRPEPSTLENITDDKYATVSSPSKSKKLECPSPAEQKPAEHVSLSNPAPLLVSPEVHLTPAVPSLPATVPAWPSEPTTFGPTGVPAPIPVLSVTQTLTTGPDSAVSQAHLTPSPVPVSIQAVNQPLMPLPQTLSLYQDPLYPGFPCNEKGDRAIVPPYSLCQTGEDLPKDKNILRFFFNLGVKAYSCPMWAPHSYLYPLHQAYLAACRMYPKVPVPVYPHNPWFQEAPAAQNESDCTCTDAHFPMQTEASVNGQMPQPEIGPPTFSSPLVIPPSQVSESHGQLPYQADLESETPGQLLHADYEESLSGKNMFPQPSFGPNPFLGPVPIAPPFFPHVWYGYPFQGFIENPVMRQNIVLPSDEKGELDLSLENLDLSKDCGSVSTVDEFPEARGEHVHSLPEASVSSKPDEGRTEQSSQTRKADTALASIPPVAEGKAHPPTQILNRERETVPVELEPKRTIQSL

SEQ ID NO: 2668 - protein, 101 aa, Homo sapiens
MGKIVTYPWVLFPVLPHGLCPSCVLCPAGCTSAPCGSLPLSLSKCPEPLSPTAAPLYPGSAALLLHDVCLPTADGGMNVDASFTAVCRHPEQDWSPEQAPD

SEQ ID NO: 2669 - protein, 118 aa, Homo sapiens
MSKTLREGMKMRGWCEEAAVKQLYSIGQDIRGNCCFHVPLPPQFGFLPQGSLWSSSLGLTPPTPHLPPPPSSLGGLPEFSTEQFHCLLSTLPGLARPFFSMTQNSFPNKSVIFLEPLH

SEQ ID NO: 2670 - protein, 447 aa, Homo sapiens
MPAPALPTSAMAVQVPLWHHYLQAIRSREAPRAQDFQRAENVLLTVLERVHALDPRFIVDYSRGLEAFQFALRSSEDPMDMEVPLWVDAEALLIEEPEATQPEDGLELCHLGVPREGAGLERWTTEDTFTASSEGDAKCRGHIVPSKVLCVLKDLLVAAIVHCKHHSLIAPGSLNAASLREEQLHLSLLVSSGWRTISFHVVPVVRRKLGAPALEGVQQMPGFPEGSLRRILSQGVDLVPASAQLWRTSTDYLLTRLLGELGSLQGHRLDSLSILDRVNHESWRDSGQTDGLTFGHLKMVLLWASVLFPAPEDWAELQGAVYRLLVVLLCCLATRKLPHFLHPQRNLLQGSGLDLGAIYQRVEGFASQPEAALRIHATHLGRSPPPRIGSGLKALLQLPASDPTYWATAYFDVLLDKFQVFNIQDKDRISAMQSIFQKTRTLGGEES

SEQ ID NO: 2671 - protein, 521 aa, Homo sapiens [sequence omitted]

SEQ ID NO: 2672 - protein, 395 aa, Homo sapiens [sequence omitted]

SEQ ID NO: 2673 - protein, 118 aa, Homo sapiens
MGGSSQRPRTTWQEGAFGFRTGMERELIESRNLETPDTEGGRYNRSCQVDFQGFALAVPETYGGLDSPVSTLPYLESCSVTQAGVQWCNLKLTATSVQVQVENLNLDDIIGTLQPSHI

SEQ ID NO: 2674 - protein, 105 aa, Homo sapiens
MSGEVSWMQAVCAGTRAPATDEVAGVHRSLLRSSRGFQGRLTRFLGRRFMTAEFLLEDPSSGSLIPQESSWKTRACEGSAAAPRQPDSQPRTAGVDMHGSLDAIS

SEQ ID NO: 2675 - protein, 112 aa, Homo sapiens
MHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 2676 - protein, 106 aa, Homo sapiens [sequence omitted]

SEQ ID NO: 2677 - protein, 342 aa, Homo sapiens
MRSHTGEKPYKCDKCGKAFSQFSMLIIHVRIHTGEKPYECNECGKAFSQSSALTVHMRSHTGEKPYECKECRKAFSHKKNFITHQKIHTREKPYECNECGKAFIQMSNLVRHQRIHTGEKPYICKECGKAFSQKSNLIAHEKIHSGEKPYECNECGKAFSQKQNFITHQKVHTGEKPYDCNECGKAFSQIASLTLHLRSHTGEKPYECDKCGKAFSQCSLLNLHMRSHTGEKPYVCNECGKAFSQRTSLIVHMGGHTGEKPYECNKCGKAFSQSSSLTIHIRGHTGEKPFDCSKCGKAFSQISSLTLHMRKHTGEKPYHCIECGKAFSQKSHLVRHQRIHTH

SEQ ID NO: 2678 - protein, 746 aa, Homo sapiens
MASIMEGPLSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQISTTLAFFQSSGISPVLEFSKIIGLDSGFVPSVQDFDKKLTEADAYLQILIEQLKLFDDKLQNCKEDEQRKKIETLKETTNSMVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 2679 - protein, 145 aa, Homo sapiens
MFSRRRLFFSFSSFLIWASSFRKTAKSHPKLGTEISQPLSLRSAGFSAFPGKAKKPKQSTGGPLSTSPHPAKWQRCHRGRGVVEVLLLRQAVEVRCPWGRKEVPRQPRHPPSGIRMGCSPTQHSHCRGRGCEVHGFSSRNQVGTG

SEQ ID NO: 2680 - protein, 151 aa, Homo sapiens
MYGCYTPTAYSTRSAPEEDWVKLCKFGFPGNALHYSAPDLPTTPVGTRSSTHLAELMTAWAQRSAHCANTRTGIAPLPEPPHRAPFKELATPLTCKQPPTLKLIRTRVFHPKGLCCGRCSDPRRGREVPKATARGWGTPLLTLVLDFEGPN

SEQ ID NO: 2681 - protein, 154 aa, Homo sapiens
MSRVSGVEACWVRAVRRCCQSWAGQPGRRGGRQSRSVERDEDVGGTDVAEAAGTAGAECLWGAREAFPEAPGGRRGEARVPGEALLHPQPEPGLCLHGPEPTVRVAVGNQLGWPTSPGWPEMFWFWDHSVPGLQPTTVTILCAPCPSSPAASLD

SEQ ID NO: 2682 - protein, 1200 aa, Homo sapiens [sequence omitted]

SEQ ID NO: 2683 - protein, 139 aa, Homo sapiens [sequence omitted]

SEQ ID NO: 2684 - protein, 289 aa, Homo sapiens
MVVVTGREPDSRRQDGAMSSSDAEDDFLEPATPTATQAGHALPLLPQEFPEVVPLNIGGAHFTTRLSTLRCYEDTMLAAMFSGRHYIPTDSEGRYFIDRDGTHFGDVLNFLRSGDLPPRERVRAVYKEAQYYAIGPLLEQLENMQPLKGEKVRQAFLGLMPYYKDHLERIVEIARLRAVQRKARFAKLKVCVFKEEMPITPYECPLLNSLRFERSESDGQLFEHHCEVDVSFGPWEAVADVYDLLHCLVTDLSAQGLTVDHQCIGVCDKHLVNHYYCKRPIYEFKITWW

SEQ ID NO: 2685 - protein, 757 aa, Homo sapiens
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKDVVTPLSTLLPPISNSIPFRGQVKGNCTWGMNCRFIHPGVNDKGNHSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRERERERERERERDREKEREKEKGKPKPRSPQPPSRQAEPPKKEAATTGPQVKRADEWKDPWRRSKSPKKKLGVSVSPSRARRRRKTSASSASASNSSRSSSRSSSYSGSGSSRSRSRSSSYSSYSSRSSRHSSFSGSRSRSRSFSSSPSPSPTPSPHRPSIRTKGEPAPPPGKAGEKSVKKPAPPPAPPQATKTTAPVPEPTKPGDPREARRKERPARTPPRRRLIKEAGSAMNHQTRTGRALLQPSGPTHPQTEVLGTGSQVGDWAPRSQSGREARTPKPLQPRLTGSASCHPSPRAPARSRACPAKPRIPAPPAPNQGRPARCLGGRSC

SEQ ID NO: 2686 - protein, 674 aa, Homo sapiens
MQSREDAPRSRRLASPRGGKRPKKIHKPTVSAFFTGPEELKDTAHSAALLAQLKSFYDARQLCDVTIEVVTPGSGPGTGRLFPCNRNVLAAACPYFKSMFTGGMYESQQASVTMHDVDAESFEVLVDYCYTGRVSLSEANVERLYAASDMLQLEYVREACASFLARRLDLTNCTAILKFADAFGHRKLRSQAQSYIAQNFKQLSHMGSIREETLADLTLAQLLAVLRLDSLDVESEQTVCHVAVQWLEAAPKERGPSAAEVFKCVRWMHFTEEDQDYLEGLLTKPIVKKYCLDVIEGALQMRYGDLLYKSLVPVPNSSSSSSSSNSLVSAAENPPQRLGMCAKEMVIFFGHPRDPFLCCDPYSGDLYKVPSPLTCLAHTRTVTTLAVCISPDHDIYLAAQPRTDLWVYKPAQNSWQQLADRLLCREGMDVAYLNGYIYILGGRDPITGVKLKEVECYNVKRNQWALVAPLPHSFLSFDLMVIRDYLYALNSKRMFCYDPSHNMWLKCVSLKRNDFQEACVFNEEIYCICDIPVMKVYNPVRAEWRQMNNIPLVSETNNYRIIKHGQKLLLITSRTPQWKKNRVTVYEYDIRGDQWINIGTTLGLLQFDSNFFCLSARVYPSCLEPGQSFLTEEEEIPSESSTEWDLGGFSEPDSESGSSSSLSDDDFWVRVAPQ

SEQ ID NO: 2687 - protein, 696 aa, Homo sapiens
MELGSCFKTYEDFKECFSAYKRENRCSFILRDCVSVRFHNLNHGTSIREDILYVQVKFVCIRTQSNRKRTREADMCPAYLLLRYNERLDRLFISELNTQHIHGDSKVASPGGDTTGKSQKTMCLQRLQPVQPTTKKDLDTAEKSLVEPSFCLDKVQVSSKPEQEGITPSDLAKIAKVMKNFLKVDEGSMASFSVGDSQHLDRLSFQSSKMTDLFIRFPENLLLHRVENTQGHILYAFLVENKERESRVVHFAVLKAETATSVAKMLSIFTEFNSDWPKVKVVFVDPSFHYRAILQEIFPAARILLSIYHTTRLLEKKLHRSSANPSFKSLMKEALREAVFVTSEASLKNLCQMSQAVLDEDLFNFLQAHWFTCELLWYMHVRKGLLACNTYMDSLDIVTSKVSSLFREQQSLLDCILCFVDYIDFFNTKGLKNLPTPPPKLKRARPASMPLKSKKAFGICGESLTSLPAEETKPDAQQVQVQQQSQVPPSQVGMLDTLHQSGSELAYKLCHNEWEVVQNSTHLVDMAGSSVDVQLLEDSHQVSKDGCSCSCSFQQWYHLPCRHILALLHTSQQPVGEAMVCRRWQKKYQYLLGPNGELQDRGMVPNTGQPEKQGRNDMIQDLSRELANLLMQTEGPELEERYSTLRKIVDIWAGPSQPSELFQQPGDFKDVGRLPFLWGKQEEGEGFPPATAVMHY

SEQ ID NO: 2688 - protein, 124 aa, Homo sapiens
MFVYSPNLSNAKGWHRGQCQAVPGYYLPLRKNSMGLPSSIPRLVLLELIMAQCSSLWKCPRQPRHSLRVLSNTTLQAAVTNHQSSAEASSLCHPCNDSLRPCPKHSGLSNTQNCNVIFCSNLNF

SEQ ID NO: 2689 - protein, 522 aa, Homo sapiens [sequence omitted]

SEQ ID NO: 2690 - protein, 451 aa, Homo sapiens
MQFVGLLATDAGYSEFLTGEGHLKVSGEANETQIAEALKRYSERAFFVREALFHLFSLTHVMEKTKPEILKLVVTGMRNHPMNLPVQLAASACVFNLTKQDLAAGMPVRLLADVTHLLLKAMEHFPNHQQLQKNCLLSLCSDRILQDVPFNRFEAAKLVMQWLCNHEDQNMQRMAVAIISILAAKLSTEQTAQLGTELFIVRQLLQIVKQKTNQNSVDTTLKFTLSALWNLTDESPTTCRHFIENQGLELFMRVLESFPTESSIQQKVLGLLNNIAEVQELHSELMWKDFIDHISSLLHSVEVEVSYFAAGIIAHLISRGEQAWTLSRSQRNSLLDDLHSAILKWPTPECEMVAYRSFNPFFPLLGCFTTPGVQLWAVWAMQHVCSKNPSRYCSMLIEEGGLQHLYNIKDHEHTDPHVQQIAVAILDSLEKHIVRHGRPPPCKKQPQARLN

SEQ ID NO: 2691 - protein, 106 aa, Homo sapiens
MRTCIYEALGCVGITLGCRQVRGPALRGAMAGRVPSTLRPPRPGGDAGPSSAKGPLRWVGLSPSWAALEKDTRPVCAPIACSVSPLVPLSLPFHICAHKIYWCLCS

SEQ ID NO: 2692 - protein, 606 aa, Homo sapiens [sequence omitted]

SEQ ID NO: 2693 - protein, 707 aa, Homo sapiens [sequence omitted]

SEQ ID NO: 2694 - protein, 585 aa, Homo sapiens
MSGILKRKFEEVDGSSPCSSVRESDDEVSSSESADSGDSVNPSTSSHFTPSSILKREKRLRTKNVHFSCVTVYYFTRRQGFTSVPSQGGSTLGMSSRHNSVRQYTLGEFAREQERLHREMLREHLREEKLNSLKLKMTKNGTVESEEASTLTLDDISDDDIDLDNTEVDEYFFLQPLPTKKRRALLRASGVKKIDVEEKHELRAIRLSREDCGCDCRVFCDPDTCTCSLAGIKCQVDRMSFPCGCTKEGCSNTAGRIEFNPIRVRTHFLHTIMKLELEKNREQQIPTLNGCHSEISAHSSSMGPVAHSVEYSIADSFEIETEPQAAVLHLQSAEELDCQGEEEEEEEDGSSFCSGVTDSSTQSLAPSESDEEEEEEEEEEEEEDDDDDKGDGFVEGLGTHAEVVPLPSVLCYSDGTAVHESHAKNASFYANSSTLYYQIDSHIPGTPNQISENYSERDTVKNGTLSLVPYTMTPEQFVDYARQAEEAYGASHYPAANPSVIVCCSSSENDSGVPCNSLYPEHRSNHPQVEFHSYLKGPSQEGFVSALNGDSHISEHPAENSLSLAEKSILHEECIKSPVVETVPV

SEQ ID NO: 2695 - protein, 124 aa, Homo sapiens
MPPVQFGGELAAALPSGTSFAEEGLTDSTGVLLLLIPCIFGSSFLLLRPFPVLRQCTAVPSKETCQEYELLDEVLLLLPRLECNGAISAHCNLYLPGSSNSPASASQVAGIIGMRHHAQLILYF

SEQ ID NO: 2696 - protein, 144 aa, Homo sapiens
MVEEVRHSAAEEEDAIHALFGSMQDRLAERKALLLQAVQSQYEEKDKAFKEQLSHLATLLPTLQVHLVICSSFLSLANKAELLDLGYAGRGLRPQGADGAPLPLPSRKDVGVTRPKAHAAPVHQHQGAAGGGREHALRRALPPL

SEQ ID NO: 2697 - protein, 440 aa, Homo sapiens
MHVRTHNGERPYVCKLCGKTFPRTSSLNRHVRIHTAEKTYECKQCGKAFIDFSSLTSHLRSHTGEKPYKCKECGKAFSYSSTFRRHTITHTGEKPYKCKECAEAFSYSSTFRRHMISHTGEKPHKCKECGEAFSYSSAFRRHMITHTGEKPYECKQCGKTFIYLQSFRRHERIHTGEKPYECKQCGKTFIYPQSFRRHERTHGGEKPYECNQCGKAFSHPSSFRGHMRVHTGEKPYECKQCGKTFNWPISLRKHMRTHTREKPYECKQCGKAFSLSACFREHVRMHPEDKSYECKLCGKAFYCHISLQKHMRRHTAEKLYKCKQCGKAFSWPELLQQHVRTHTVEKPYECKECGKVFKWPSSLPIHMRLHTGEKPYQCKHCGKAFNCSSSLRRHVRIHTTEKQYKCNVGHPPANEFMCSASEKSHQERDLIKVVNMVLPL

SEQ ID NO: 2698 - protein, 837 aa, Homo sapiens
MPALHRAPVFHPPIHHSLERREGSYSSLSPPTLTPVMPVNAGGKVQESQKPPTLIPEPKDSQANFKSSSEQSLTEMWRPNNNLSKEKTEWHVEKSSGKLQAAMASVIVRPSSSTKTDSMPAMQLASKDRVSERSSAGAHKTDCLKLAEAGETGRIILPNVNSDSVHTKSEKNFQAVSQGSVPSSVMSAVNTMCNTKTDVITSAADTTSVSSWGGSEVISSLSNTILASTSSECVSSKSVSQPVAQKQECKVSTTAPVTLASSKTGSVVQPSSGFSGTTDFIHLKKHKAALAAAQYKSSNASETEPNAIKNQTLSASLPLDSTVICSTINKANSVGNGQASQTSQPNYHTKLKKAWLTRHSEEDKNTNKMENSGNSVSEIIKPCSVNLIASTSSDIQNSVDSKIIVDKYVKDDKVNRRKAKRTYESGSESGDSDESESKSEQRTKRQPKPTYKKKQNDLQKRKGEIEEDLKPNGVLSRSAKERSKLKLQSNSNTGIPRSVLKDWRKVKKLKQTGESFLQDDSCCEIGPNLQKCRECRLIRSKKGEEPAHSPVFCRFYYFRRLSFSKNGVVRIDGFSSPDQYDDEAMSLWTHENFEDDELDIETSKYILDIIGDKFCQLVTSEKTALSWVKKDAKIAWKRAVRGVREMCDACEATLFNIHWVCQKCGFVVCLDCYKAKERKSSRDKELYAWMKRVKGQPHDHKHLMPTQIIPGSVLTDLLDAMHTLREKYGIKSHCHCTNKQNLQVGNFPTMNGVSQVLQNVLNHSNKISLCMPESQQQNTPPKSEKNGGSSPESDVGTDNKLTPPESQSPLHWLADLAEQKAREEKKENKELTLENQI

SEQ ID NO: 2699 - protein, 1196 aa, Homo sapiens
MENEPDHENVEQSLCAKTSEEELNKSFNLEASLSKFSYIDMDKELEFKNDLIDDKEFDIPQVDTPPTLESILNETDDEDESFVLEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFGKDQNQALRLCLGSTSVGGQYGAISALSINNDCSRLLCGFAKGQITMWDLASGKLLRSITDAHPPGTAILHIKFTDDPTLAICNDSGGSVFELTFKRVMGVRTCESRCLFSGSKGEVCCIEPLHSKPELKDHPITQFSLLAMASLTKILVIGLKPSLKVWMTFPYGRMDPSSVPLLAWHFVAVQNYVNPMLAFCRGDVVHFLLVKRDESGAIHVTKQKHLHLYYDLINFTWINSRTVVLLDSVEKLHVIDRQTQEELETVEISEVQLVYNSSHFKSLATGGNVSQALALVGEKACYQSISSYGGQIFYLGTKSVYVMMLRSWRERVDHLLKQDCLTEALALAWSFHEGKAKAVVGLSGDASKRKAIVADRMVEILFHYADRALKKCPDQGKIQVMEQHFQDMVPVIVDYCLLLQRKDLLFSQMYDKLSENSVAKGVFLECLEPYILSDKLVGITPQVMKDLIVHFQDKKLMENVEALIVHMDITSLDIQQVVLMCWENRLYDAMIYVYNRGMNEFISPMEKLFRVIAPPLNAGKTLTDEQVVMGNKLLVYISCCLAGRAYPLGDIPEDLVPLVKNQVFEFLIRLHSAEASPEEEIYPYIRTLLHFDTREFLNVLALTFEDFKNDKQAVEYQQRIVDILLKVMVENSDFTPSQVGCLFTFLARQLAKPDNTLFVNRTLFDQVLEFLCSPDDDSRHSERQQVLLELLQAGGIVQFEESRLIRMAEKAEFYQICEFMYEREHQYDKIIDCYLRDPLREEEVFNYIHNILSIPGHSAEEKQSVWQKAMDHIEELVSLKPCKAAELVATHFSGHIETVIKKLQNQVLLFKFLRSLLDPREGIHVNQELLQISPCITEQFIELLCQFNPTQVIETLQVLECYRLEETIQITQKYQLHEVTAYLLEKKGDIHGAFLIMLERLQSKLQEVTHQGENTKEDPSLKDVEDTMVETIALCQRNSHNLNQQQREALWFPLLEAMMAPQKLSSSAIPHLHSEALKSLTMQVLNSMAAFIALSNNKCSVFKF

SEQ ID NO: 2700 - protein, 558 aa, Homo sapiens [sequence omitted]

SEQ ID NO: 2701 - protein, 577 aa, Homo sapiens [sequence omitted]

SEQ ID NO: 2702 - protein, 340 aa, Homo sapiens
MPEWPPCLSVAPALVITMAAGKGAPLSPSAENRWRLSEPELGRGCKPVLLEKTNRLGPEAAVGRAGRDVGSAELALLVAPGKPRPGKPLPPKTRGEQRQSAFTELPRMKDRQVDAQAQEREHDDPTGQPGAPQLTQNIPRGPAGSKVFSVWPSGARSEQRSAFSKPTKRPAERPELTSVFPAGESADALGELSGLLNTTDLACWGRLSTPKLLVGDLWNLQALPQNAPLCSTFLGAPTLWLEHTQAQVPPPSSSSTTSWALLPPTLTSLGLSTQNWCAKCNLSFRLTSDLVFHMRSHHKKEHAGPDPHSQKRREEALACPVCQEHFRERHHLSRHMTSHS

SEQ ID NO: 2703 - protein, 942 aa, Homo sapiens
MKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAP

SEQ ID NO: 2704 - protein, 188 aa, Homo sapiens
MGRAVATAAIPLGTSVASWSRPCSTSSRWTRISSGDPKLPVLYQVERTRTGSSFSVRSVKAVQHGKPIFICQASFQQAQPSPMQHQFSMPTVPPPEELLDCETLIDQYLRDPNLQKRYPLALNRIAAQEVPIEIKPVNPSPLSQLQRMEPKQMFWVRARGYIGKSTPWMGGNHSPRGLPLICCVALGT

SEQ ID NO: 2705 - protein, 1162 aa, Homo sapiens
MLNFLKKAIQDPAFSDGIRHVMDGSLPTSLKHIISNAEYYGPSLFLLATEVVTVFVFQEPSLLSSLQDDGLTDVMLHALLIKDVPATREVLGSLPNVFSALCLNARGLQSFVQCQPFERLFKVLLSPDYLPAMRRRRSSDPLGDTASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQGTSAE

SEQ ID NO: 2706 - protein, 600 aa, Homo sapiens
MACYLVISSRHLSNGHYRGIKGVFRGPLCKNGSPSPDFAEKKSTAKALEDVKANFYCELCDKQYHKHQEFDNHINSYDHAHKQRLKELKQREFARNVASKSWKDEKKQEKALKRLHQLAELRQQSECVSGNGPAYKAPRVAIEEQLQQGIFPIKNGRKVSCMKSALLLKGKNLPRIISDKQRSTMPNRHQLQSDRRCLFGNQVLQTSSDLSNANHRTGVSFTFSKKVHLKLESSASVFSENTEETHDCNKSPIYKTKQTADKCKCCRFANKDTHLTKEKEVNISPSHLESVLHNTISINSKILQDKHDSIDETLEDSIGIHASFSKSNIHLSDVDFTPTSREKETRNTLKNTLENCVNHPCQANASFSPPNIYNHSDARISECLDEFSSLEPSEQKSTVHLNPNSRIENREKSLDKTERVSKNVQRLVKEACTHNVASKPLPFLHVQSKDGHTTLQWPTELLLFTKTEPCISYGCNPLYFDFKLSRNTKEDHNLEDLKTELGKKPLELKTKRESQVSGLTEDQQKLIQEDYQYPKPKTMIANPDWEKFQRKYNLDYSDSEPNKSEYTFSANDLEMKNPKVPLYLNTSLKDCAGKNNSSEN

SEQ ID NO: 2707 - protein, 883 aa, Homo sapiens
MELYFGEYQHVQQEYGVHLRLASDDTQKSRSSQNSKAGSYGVSIRVQGIDGHPYIVLNNTERCLAGTSFSENGPPFPPPVINNLPLHSSNGSVPKENSEELQLPENPYAQPSPIRNLKQPLLHEGKNGVLDRKDGSVKPSHLLNFQRHPELLQPYDPEKNELNLQNHQPSESNWLKTLTEEGINNKKPWTCFPKPSNSQPTSPSLEDPAKSGVTAIRLCSSVVIEDPKKQTSVCVNVQSCTKERVGEEALFTSGRPLTAHSPHAHPETKKTRPDVLPFRRQDSAGPVLDGARSRRSSSSSTTPTSANSLYRFLLDDQECAIHADNVNRHENRRYIPFLPGTGRDIDTGSIPGVDQLIEKFDQKPGLQRRGRSGKRNRINPDDRKRSRSVDSAFPFGLQGNSEYLIEFSRNLGKSSEHLLRPSQVCPQRPLSQERRGKQSVGRTFAKLQGAAHGASCAHSRPPQPNIDGKVLETEGSQESTVIRAPSLGAQSKKEEEVKTATATLMLQNRAAATSPDSGAKKISVKTFPSASNTQATPDLLKGQQELTQQTNEETAKQILYNYLKEGSTDNDDATKRKVNLVFEKIQTLKSRAAGSAQGNNQACNSTSEVKDLLEQKSKLTIEVAELQRQLQLEVKNQQNIKEERERMRANLEELRSQHNEKVEENSTLQQRLEESEGELRKNLEELFQVKMEREQHQTEIRDLQDQLSEMHDELDSAKRSEDREKGALIEELLQAKQDLQDLLIAKEEQEDLLRKRERELTALKGALKEEVSSHDQEMDKLKEQYDAELQALRESVEEATKNVEVLASRSNTSEQDQAGTEMRVKLLQEENENLQGRSEELERRVAQLQRQIEDLKGDEAKAKETLKKFEGEIRQLEEALVHA

SEQ ID NO: 2708 - protein, 208 aa, Homo sapiens
MDKFVIRTPRIQNSPQKKDSGGKVYKQATIESLKRVVVVEDIKRWKTMLELPDQTKENLVEALQELKKKIPSREVLKSTRIGHTVNKMRKHSDSEVASLAREVYTEWKTFTEKHSNRPSIEVRSDPKTESLRKNAQKLLSEALELKMDHLLVENIERETFHLCSRLINGPYRRTVRALVFTLKHRAEIRAQVKSGSLPVGTFVQTHKK

SEQ ID NO: 2709 - protein, 132 aa, Homo sapiens [sequence omitted]

SEQ ID NO: 2710 - protein, 273 aa, Homo sapiens
MEAAPSRFMFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 2711 - protein, 100 aa, Homo sapiens
MELTTLEVALSESIKLFDFIITLKTVVQLYKNSFFKLFYFLDFFVKSKEETHISLGLHRVRIINITGFYLHIFSHWKVIQGSNMHGVVISCNDDTFWNTS

SEQ ID NO: 2712 - protein, 142 aa, Homo sapiens [sequence omitted]

SEQ ID NO: 2713 - protein, 600 aa, Homo sapiens
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTSYSSTQPTSYDQSSYSQQNTYGQPSSYGQQGSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 2714 - protein, 197 aa, Homo sapiens [sequence omitted]

SEQ ID NO: 2715 - protein, 881 aa, Homo sapiens
MPNSASRDEFPCGFTSPANRGSLSTDKDTAYGSFQNGHGIKREDSRGSLIPEGATGFPDQGNTGENTRQSSTRSSVSQYNRLDQYEIRSLLMCYLYIVKMISEDTLLTYWNKVSPQELINILILLEVCLFHFRYMGKRNIARVHDAWLSKHFGIDRKSQTMPALRNRSGVMQARLQHLSSLESSFTLNHSSTTTEADIFHQALLEGNTATEVSLTVLDTISFFTQCFKTQLLNNDGHNPLMKKVFDIHLAFLKNGQSEVSLKHVFASLRAFISKFPSAFFKGRVNMCAAFCYEVLKCCTSKISSTRNEASALLYLLMRNNFEYTKRKTFLRTHLQIIIAVSQLIADVALSGGSRFQESLFIINNFANSDRPMKATAFPAEVKDLTKRIRTVLMATAQMKEHEKDPEMLIDLQYSLAKSYASTPELRKTWLDSMAKIHVKNGDFSEAAMCYVHVAALVAEFLHRKKLFPNGCSAFKKITPNIDEEGAMKEDAGMMDVHYSEEVLLELLEQCVDGLWKAERYEIISEISKLIVPIYEKRREFEKLTQVYRTLHGAYTKILEVMHTKKRLLGTFFRVAFYGQSFFEEEDGKEYIYKEPKLTGLSEISLRLVKLYGEKFGTENVKIIQDSDKVNAKELDPKYAHIQVTYVKPYFDDKELTERKTEFERNHNISRFVFEAPYTLSGKKQGCIEEQCKRRTILTTSNSFPYVKKRIPINCEQQINLKPIDVATDEIKDKTAELQKLCSSTDVDMIQLQLKLQGCVSVQVNAGPLAYARAFLNDSQASKYPPKKVSELEDMFRKFIQACSIALELNERLIKEDQVEYHEGLKSNFRDMVKELSDIIHEQILQEDTMHSPWMSNTLHVFCAISGTSSDRGYGSPRYAEV

SEQ ID NO: 2716 - protein, 145 aa, Homo sapiens [sequence omitted]

SEQ ID NO: 2717 - protein, 341 aa, Homo sapiens
MKPLLYSQLDANTRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKRLLEEREVLLYCDFHGHSRKNNIFLYGCNNNNRKYWLHERVFPLMLCKNAPDKFSFHSCNFKVQKCKEGTGRVVMWRMGILNSYTMESTFGGSTLGNKRDTHFTIEDLKSLGYHVCDTLLDFCDPDQIKHQWL

SEQ ID NO: 2718 - protein, 919 aa, Homo sapiens [sequence omitted]

SEQ ID NO: 2719 - protein, 127 aa, Homo sapiens [sequence omitted]

SEQ ID NO: 2720 - protein, 130 aa, Homo sapiens
MADEALFLLLHNEMVSGVYKSAEQGEVENGRCITKLENMGFRVGQGLIERFTKDTARFKDELDIMKFICKDFWTTVFKKQIDNLRTNHQYLAFTCGLIRGGLSNLGIKSIVTAEVSSMPACKFQVMIQKL

SEQ ID NO: 2721 - protein, 314 aa, Homo sapiens [sequence omitted]

SEQ ID NO: 2722 - protein, 390 aa, Homo sapiens
MGPPLAPRPAHVPGEAGPRRTRESRPGAVSFADVAVYFSPEEWECLRPAQRALYRDVMRETFGHLGALGFSVPKPAFISWVEGEVEAWSPEAQDPDGSRDGNEEKERLKKCPKQKEVAHEVAVKEWWPSVACPEFCNPRQSPMNPWLKDTLTRRLPHSCPDCGRNFSYPSLLASHQRVHSGERPFSCGQCQARFSQRRYLLQHQFIHTGEKPYPCPDCGRRFRQRGSLAIHRRAHTGEKPYACSDCKSRFTYPYLLAIHQRKHTGEKPYSCPDCSLRFAYTSLLAIHRRIHTGEKPYPCPDCGRRFTYSSLLLSHRRIHSDSRPFPCVECGKGFKRKTALEAHRWIHRSCSERRAWQQAVVGRSEPIPVLGGKDPPVHFRHFPDIFQECG

SEQ ID NO: 2723 - protein, 530 aa, Homo sapiens
MGPLTIRDVTVEFSLEEWHCLDTAQQNLYRDVMLENYRNLVFLGIAVSKPDLCPERDIKYFFQKVILRRYDKCEHENLQLRKGCKSVDECKVCKGGYNGLNQCLITTQSKMYQCDKYVKVFYKFSNSDRHKIRHTEKKTCKCKECGKSFCMLSQLTRHKRIHIRENSHKCEECGKAFNQSSALTRHKMTHTGEKPYKCEECGKAFNRSSHLTQHKVIHTREKPYKCEECGKAFNRSSHITQHKRIHNREKPFKYDECCKAFKWSSALTTLTQHKRIHTGEKPYKCEECGKAFNQSSALTRHKMIHTGEKPFQCEECGKAFNRSSHLTQHKIIHTKEKPYKCEECGKAFNRSSHLTKHKRIHTREKAYKCDEYCKAFNWSSALTTLTQHKIIHTGEKPYKCEECGKAFNRSSYLIRHKIIHTGEKPYKCEECGKAFNQSSHLTQHKIIHTGEKPYKCEECGKAFNRSSHLSQHKIIHTGEKPYKCEECGKPFNRFSYLTVHKRIHAGENPNKYEECGKACNHSSNLTKHNS

SEQ ID NO: 2724 - protein, 338 aa, Homo sapiens
MQHQRIHTGEKPYKCEECGKAFIRGSQLTQHQRIHTNEKPYECKECGKMFSHGSQLTQHQRIHTGEKPYQCKECGKAFNRGSLLTRHQRIHTGEKPYECKECGKTFSRGSELTQHERIHTGEKPYECKECGKSFIRGSQLTQHQRIHTGEKPYECKECRMAFTQSSHLSQHQRLHTGEKPYVCNECGKAFARGLLLIQHQRIHTGEKPYQCKECGKAFIRGSQLTQHQRIHTGEKPYECKECGKAFSHGSQLTLHQRIHTGEKPYECRECRKAFTQSSHLSRHQRIHTGEKPYQCKECGKAFTRGSQLTQHQRIHISEKSFEYKECGIDFSHGSQVYM

SEQ ID NO: 2725 - protein, 198 aa, Homo sapiens
MAREPRKNAALDAQSAEDQTGLLTVKVEKEEASALTAEVRAPCSPARGPERSRQRFRGFRYPEAAGPREALSRLRELCGQWLQPEMHSKEQILELLVLEQFLTILPGNLQSWVREQHPESGEEVVVLLEYLERQLDEPAPQVERTGLVSERCGLFPPEIPDRSEGHSFKVQEFFISFCTVNLLGSKVKSLDSFSELYF

SEQ ID NO: 2726 - protein, 485 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEAQAEEWYFGKLGRKDAERQLLSFGNPRGTFLIRESETTKGAYSLSIRDWDDMKGDHVKHYKIRKLDNGGYYITTRAQFETLQQLVQHYSEKADGLCFNLTVIASSCTPQTSGLAKDAWEVARRSLCLEKKLGQGCFAEVWLGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 2727 - protein, 308 aa, Homo sapiens
MLFKKNLFEMAINLAKSQHLDSDGLAQIFMQYGDHLYSKGNHDGAVQQYIRTIGKLEPSYVIRKFLDAQRIHNLTAYLQTLHRQSLANADHTTLLLNCYTKLKDSSKLEEFIKKKSESEVHFDVETAIKVLRQAGYYSHALYLAENHAHHEWYLKIQLEDIKNYQEALRYIGKLPFEQAESNMKRYGKILMHHIPEQTTQLLKGLCTDYRPSLEGRSDREAPGCRANSEEFIPIFANNPRELKAFLEHMSEVQPDSPQGIYDTLLELRLQNWAHEKDPQVRPGQGFRRKDSSCRLHSSVLVAAFHCIP

SEQ ID NO: 2728 - protein, 945 aa, Homo sapiens [sequence omitted]

SEQ ID NO: 2729 - protein, 122 aa, Homo sapiens [sequence omitted]

SEQ ID NO: 2730 - protein, 570 aa, Homo sapiens
MDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKIRHSCCCRWRVLDWVPWLL

SEQ ID NO: 2731 - protein, 926 aa, Homo sapiens
MEKRSSGRRSGRRRGSQKSTDSPGADAELPESAARDDAVFDDEVAPNAASDNASAEKKVKSPRAALDGGVASAASPESKPSPGTKGQLRGESDRSKQPPPASSPTKRKGRSRALEAVPAPPASGPRAPAKESPPKRVPDPSPVTKGTAAESGEEAARAIPRELPVKSSSLLPEIKPEHKRGPLPNHFNGRAEGGRSRELGRAAGAPGASDADGLKPRNHFGVGRSTVTTKVTLPAKPKHVELNLKTPKNLDSLGNEHNPFSQPVHKGNTATKISLFENKRTNSSPRHTDIRGQRNTPASSKTFVGRAKLNLAKKAKEMEQPEKKVMPNSPQNGVLVKETAIETKVTVSEEEILPATRGMNGDSSENQALGPQPNQDDKADVQTDAGCLSEPVASALIPVKDHKLLEKEDSEAADSKSLVLENVTDTAQDIPTTVDTKDLPPTAMPKPQHTFSDSQSPAESSPGPSLSLSAPAPGDVPKDTCVQSPISSFPCTDLKVSENHKGCVLPVSRQNNEKMPLLELGGETTPPLSTERSPEAVGSECPSRVLVQVRSFVLPVESTQDVSSQVIPESSEVREVQLPTCHSNEPEVVSVASCAPPQEEVLGNEHSHCTAELAAKSGPQVIPPASEKTLPIQAQSQGSRTPLMAESSPTNSPSSGNHLATPQRPDQTVTNGQDSPASLLNISAGSDDSVFDSSSDMEKFTEIIKQMDSAVCMPMKRKKARMPNSPAPHFAMPPIHEDHLEKVFDPKVFTFGLGKKKESQPEMSPALHLMQNLDTKSKLRPKRASAEQSVLFKSLHTNTNGNSEPLVMPEINDKENRDVTNGGIKRSRLEKSALFSSLLSSLPQDKIFSPSVTSVNTMTTAFSTSQNGSLSQSSVSQPTTEGAPPCGLNKEQSNLLPDNSLKVFNFNSSSTSHSSLKSPSHMEKYP

SEQ ID NO: 2732 - protein, 605 aa, Homo sapiens
MALPACAVREFEPPRQPERGAPVRTTCPRRHSRVEAELAASRPGSVAASVRAGPPRGVSHGFHTRPLLDKPRKASSSLAGAACAPLFALLSRGRRRRMHVLRRRWDLGSLCRALLTRGLAALGHSLKHVLGAIFSKIFGPMASVGNMDEKSNKLLLALVMLFLFAVIVLQYVCPGTECQLLRLQAFSSPVPGPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQNLSQKENRESPKQNSGKEQNDNTSNGTNDYIGSVEKWR

SEQ ID NO: 2733 - protein, 1461 aa, Homo sapiens [sequence omitted]

SEQ ID NO: 2734 - protein, 116 aa, Homo sapiens [sequence omitted]

SEQ ID NO: 2735 - protein, 686 aa, Homo sapiens
MLAVPEMGLQGLYIGSSPERSPVPSPPGSPRTQESCGIAPLTPSQSPKPEVRAPQQASFSVVVAIDFGTTSSGYAFSFASDPEAIHMMRKWEGGDPGVAHQKTPTCLLLTPEGAFHSFGYTARDYYHDLDPEEARDWLYFEKFKMKIHSATDLTLKTQLEAVNGKTMPALEVFAHALRFFREHALQELREQSPSLPEKDTVRWVLTVPAIWKQPAKQFMREAAYLAGLVSRENAEQLLIALEPEAASVYCRKLRLHQLLDLSGRAPGGGRLGERRSIDSSFRQAREQLRRSRHSRTFLVDSGVGELWAEMQAGDRYVVADCGGGTVDLTVHQLEQPHGTLKELYKASGGPYGAVGVDLAFEQLLCRIFGEDFIATFKRQRPAAWVDLTIAFEARKRTAGPHRAGALNISLPFSFIDFYRKQRGHNVETALRRSSVNFVKWSSQGMLRMSCEAMNELFQPTVSGIIQHIEALLARPEVQGVKLLFLVGGFAESAVLQHAVQAALGARGLRVVVPHDVGLTILKGAVLFGQAPGVVRVRRSPLTYGVGVLNRFVPGRHPPEKLLVRDGRRWCTDVFERFVAAEQSVALGEEVRRSYCPARPGQRRVLINLYCCAAEDARFITDPGVRKCGALSLELEPADCGQDTAGAPPGRREIRAAMQFGDTEIKVTAVDVSTNRSVRASIDFLSN

SEQ ID NO: 2736 - protein, 106 aa, Homo sapiens [sequence omitted]

SEQ ID NO: 2737 - protein, 144 aa, Homo sapiens [sequence omitted]

SEQ ID NO: 2738 - protein, 141 aa, Homo sapiens [sequence omitted]

SEQ ID NO: 2739 - protein, 131 aa, Homo sapiens
MDSTHPQHCACNSQIRPRWDCVAHCFLWAPGLPSRDDPGADKGEASGGVGTVSLTLSQPRERSLQVKKVFVKGMKKERALGEGAAWWQSQRLVSPGKHDRVSTHRKSQSVFTGVSAGDKQFTTTFSIVFTI

SEQ ID NO: 2740 - protein, 310 aa, Homo sapiens
MSQQLKKRAKTRHQKGLGGRAPSGAKPRQGKSSQDLQAEIEPVSAVWALCDGYVCYEPGPQALGGDDFSDCYIECVIRGEFSQPILEGDSLFESLEYLKKGSEQQLSQKVFEASSLECSLEYMKKGVKKELPQKIVGENSLEYSEYMTGKKLPPGGIPGIDLSDPKQLAEFARKKPPINKEYDSLSAIACPQSGCTRKLRNRAALRKHLLIHGPRDHVCAECGKAFVESSKLKRHFLVHTGEKPFRCTFEGCGKRFSLDFNLRTHVRIHTGEKRFVCPFQGCNRRFIQSNNLKAHILTHANTNKNEQEGK

SEQ ID NO: 2741 - protein, 205 aa, Homo sapiens [sequence omitted]

SEQ ID NO: 2742 - protein, 115 aa, Homo sapiens
MYAHVWSRLSWSLGAGKWAAGKWIGGELEEYKERGWRLRLWTRTAPRLGRPGLSRPQPRGRAVKKALPAPAVMTQSSLPRPASYVCLPPSSWWHFSRPVSQHCARLGREPGSETG

SEQ ID NO: 2743 - protein, 218 aa, Homo sapiens
MRDSSIWAFVLGPYQPCLVPQCFVRPTEAKKAADEAKMRFAHIDGDHLTLLNVYHAFKQNHESVQWCYDNFINYRSLMSADNVRQQLSRIMDRFNLPRRSTDFTSRDYYINIRKALVTGYFMQVAHLERTGHYLTVKDNQVVQLHPSTVLDHKPEWVLYNEFVLTTKNYIRTCTDIKPEWLVKIAPQYYDMSNFPQCEAKRQLDRIIAKLQSKEYSQY

SEQ ID NO: 2744 - protein, 200 aa, Homo sapiens [sequence omitted]

SEQ ID NO: 2745 - protein, 120 aa, Homo sapiens [sequence omitted]

SEQ ID NO: 2746 - protein, 181 aa, Homo sapiens [sequence omitted]

SEQ ID NO: 2747 - protein, 114 aa, Homo sapiens [sequence omitted]

SEQ ID NO: 2748 - protein, 163 aa, Homo sapiens [sequence omitted]

SEQ ID NO: 2749 - protein, 109 aa, Homo sapiens
MEDLLDLDEELRYSLATSRAKMGRRAQQESAQAENHLNGKNSSLTLTGETSSAKLPRCRQGGWAGDSVKASKFRRKASEEIEDFRLRPQSLNGSDYGGAVPKQANNSWI

SEQ ID NO: 2750 - protein, 841 aa, Homo sapiens
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGR

SEQ ID NO: 2751 - protein, 142 aa, Homo sapiens
MGLYHVGQAGLELLTSSDPPTSASQNAEITGVSHRAQSKAHNLQRKLRLSHKSSPPCTYTQHAGGVDSHPLTQDMCVIVNVIARPFDKCNCDIYLGLASELFVVSWVQLTVPYHWIQTLGNVILFCLDTAHRGHCDIAGHCT

SEQ ID NO: 2752 - protein, 533 aa, Homo sapiens [sequence omitted]

SEQ ID NO: 2753 - protein, 506 aa, Homo sapiens
MEKEYRLSAIPAFKYYEACTFLVFLSNFIIQMLVTNRPPALAITYSITFLLFLLILFVCFSEDLMRCVLKGPKMLHWLPALSGLVATRPGLRIALGTATILLVFAMAITSLFFFPTSSDCPFQAPNVSSMISNLSWELPGSLPLISVPYSMHCCTLGFLSCSLFLHMSFELKLLLLLLWLAASCSLFLHSHAWLSECLIVRLYLGPLDSRPGVLKEPKLMGAISFFIFFFTLLVLARQNEYYCRLDFLWKKKLRQEREETETMENLTRLLLENVLPAHVAPQFIGQNRRNEDLYHQSYECVCVLFASVPDFKEFYSESNINHEGLECLRLLNEIIADFDELLSKPKFSGVEKIKTIGSTYMAATGLNATSGQDAQQDAERSCSHLGTMVEFAVALGSKLDVINKHSFNNFRLRVGLNHGPVVAGVIGAQKPQYDIWGNTVNVASRMESTGVLGKIQVTEETAWALQSLGYTCYSRGVIKVKGKGQLCTYFLNTDLTRTGPPSATLG

SEQ ID NO: 2754 - protein, 116 aa, Homo sapiens
MKLQLQFWGGLDPSSGGAGLPRPLGLERRVPGPSYQRSAGSGPAARVLLGSQGHGWVNGLTAGLLAQQTLSSPMAQSTSSLQGQLEGRGTTRPSLQLALPLQLRGGLNYRTHSQDP

SEQ ID NO: 2755 - protein, 169 aa, Homo sapiens
MKLLTLQPPGMLWLMERGGLGKPRGPRHPGGDIADPWLGAPWGPAGLDPHPRECRASPHVCAWPCLCISTCVALQKQPSSWGSWTLHVSVSPQPPARRPLPRALPPPHPLVSQRCCSLQRKGLWETPGLFPPPPSACLLGLPACLPCTWGYPHPLPFPLLTKEKNEFQT

SEQ ID NO: 2756 - protein, 123 aa, Homo sapiens
MTVGARLRSAADERGPGTRGARGRTEGDEEAAAILEHLEYADEAEAAAESGTSAADERYEPLEEPAPSEQPRKRYRRKLKKYGKNVGKVIIKGCRYVVIGLQGFAAAYSAPFAVATSVVSFVR

SEQ ID NO: 2757 - protein, 242 aa, Homo sapiens
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGLLVLYILLASSWKRPEPGILTDRQPLLHDGE

SEQ ID NO: 2758 - protein, 164 aa, Homo sapiens
MYCTGGIRCERGSAYLKAKGVCKEVFQLKGGIHKYLEEFPDGFYKGKLFVFDERYALSYNSDVVSECSYCGARWDQYKLCSTPQCRQLVLTCPACQGQGFTACCVTCQDKGSRKVSGPMQDSFKEECECTARRPRIPRELLQHVRQPVSPEPGPDADEDGPVLM

SEQ ID NO: 2759 - protein, 536 aa, Homo sapiens
MARKLVMFRDVAIDFSQEEWECLDSAQRDLYRDVMLENYSNLVSLDLPSRCASKDLSPEKNTYETELSQWEMSDRLENCDLEESNSRDYLEAKGKMEKQQENQKEYFRQGMIIYDKMSIFNQHTYLSQHSRCHSTEKPYKCKECGKAFRRASHLTQHQSIHTGEKPYECKQCGKAFSRDSQLSLHQRLHTGEKPYACKECGKAFTQSSQLILHHRIHTGEKPYKCEECGKAFIRSSQLTRHQKVHTGEKPYECKECGKAFTQNSQLTLHQRLHTGEKLYECKECRKVFTQLSQLILHKRIHTGEKPYECKECGKAFICGSQLSQHQKIHNGEKPYECKECGRAFIRGSLLMQHQRIHTGEKPYKCEECGKAFIRGSQLTQHQRIHTNEKPYECKECGKMFSHGSQLTQHQRIHTGEKPYQCKECGKAFNRGSLLTRHQRIHTGEKPYECKECGKTFSRGSELTQHERIHTAFLAGQQDRSDIYMSRRFTKSIFPVFFSVPTMWTSKLELRYSHGDFENGIWVLWIMEQKYRRSLQP

SEQ ID NO: 2760 - protein, 376 aa, Homo sapiens
MKHFKKEKSEAENHIRTLKAESLEEKNMAKIHRGQLEKLKSQCDRLTEELTQNENENKKLKLKYQCLKDQLEEREKHISIEEEHLRRMEEARLQLKDQLLCLETEQESILGVIGKEIDAACKTFSKDSVEKLKVFSSGPDIHYDPHRWLAESKTKLQWLCEELKERENREKNLRHQLMLCRQQLRNLTENKESELQCLFQQIERQEQLLDEIHREKRDLLEETQRKDEEMGSLQDRVIALETSTQVALDHLESVAEKLSLLEDFKDFRDSCSSSERTDGRYSKYRVRRNSLQHHQDDTKYRTKSFKGDRTFLEGSHTRGLDHSSSWQDHSRFLSSPRFSYVNSFTKRTVAPDSASNKEDATMNGTSSQPKKEEYGS

SEQ ID NO: 2761 - protein, 530 aa, Homo sapiens [sequence omitted]

SEQ ID NO: 2762 - protein, 110 aa, Homo sapiens
MHTDIRTPTHMCMDTCTCTHGCTSMHTCTCTHKHAHTDTHGHMHTNMHVHTHMHAYTHEHVLNIYIHVDICTYPHIHTYICTLYVQYTQTYSPHERESDYARCSTLLVFI

SEQ ID NO: 2763 - protein, 265 aa, Homo sapiens
MGLPWGQPHLGLQMLLLALNCLRPSLSLELVPYTPQITAWDLEGKVTATTFSLEQPRCVFDGLASASDTVWLVVAFSNASRGFQNPETLADIPASPQLLTDGHYMTLPLSPDQLPCGDPMAGSGGAPVLRVGHDHGCHQQPFCNAPLPGPGPYREDPRIHRHLARAAKWQHDRHYLHPLFSGRPPTLGLLGSLYHALLQPVVAGGGPGAAADRLLHGQALHDPPHPTQRGRHTAGGLQAWPGPPPQPQPLAWPLCMGLGEMGRRE

SEQ ID NO: 2764 - protein, 115 aa, Homo sapiens
MRPRGPGALEPTPSLFSQLALPDLWRKTSENITLSSHLLPLAKIPIKAWLQPLRLGTLSKWSVGSVGEEGRKEVGHTLATAQRGRGQPRKGRRVAAMPSFQRWREGLGSHLGEAA

SEQ ID NO: 2765 - protein, 373 aa, Homo sapiens
MQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 2766 - protein, 219 aa, Homo sapiens
MVCRQLRPSSCPVAVPVIRVCLSRGLREWARCGRSPAWGGVCVCARTPAIKAAGLRGCSLLVFTGGGPVGTHGRESGSHVVRSPLCSGDPRRSCSTAQKPLPTGSGPPDTDPTGRPGSQRTQAGAPHHLTVSRIQAVCPGATSHQLWSVQGERGGLLGAWRGEGLLQSRERGCSLGDVGGHGCGGGRRRTLRGVVGGGGSRVREQVESLEGQDQDAAGL

SEQ ID NO: 2767 - protein, 206 aa, Homo sapiens
MERVAEAYGKGSQGSARECHHPSWGMQGKVPGGSFPGKPKKRPTKTESTFGYLWYPEAAMPTTTTLEEEDLLRIDSLISSSFMAPALGNQHGGEIMKLEYNHLQTSQPPPVDTKGILGSHFISHLSKKSYRSISSRGQESPEEFKGLWQEKSRGCVQELAPLVIVLRSPCVLDADEIAAKCLCSLGKALYFSGSPFLSLSFFFFFF

SEQ ID NO: 2768 - protein, 112 aa, Homo sapiens [sequence omitted]

SEQ ID NO: 2769 - protein, 152 aa, Homo sapiens
MLAGRPAALEGLSVPPLHRPPEEGCWVSGCLLLPVSAAELSRVLGRRSAPGSGNNCGPGVRQPSSRGRGPDRGALGWRRLPGTRGVEGRPLPAEAGDCASTGASALLETPDAAAELPPQLRKPAPTRRACAVPVLPVWAARPPIPAGCLVEG

SEQ ID NO: 2770 - protein, 256 aa, Homo sapiens [sequence omitted]

SEQ ID NO: 2771 - protein, 224 aa, Homo sapiens
MYFYVGHKKNKLPFDGSPKITYSTPPVANLYTCINNIQHTGECAVGLLGPRGIGVTIYNTTQPRQKRALGLILAGMGAAIGMIAPWGGFTYHDVTLRNLSRQIDNIAKSTRDSISKLKASIDSLANVVMNNRLALDYLLAEQGGVCAVISKSCCIYVNNSGAIEEDIKKIYDEVTWLHNFGKGDSAGSIWEAVKSALPSLTWFVPLLGPAALNSLLSPLWPLSL

SEQ ID NO: 2772 - protein, 108 aa, Homo sapiens
MIHSLGEVPLKWARERGNPAPPHWPQVEAVTPVLKVWIGGPGRSETPTHSYEICSGPGAVAHACNPSTLGARGRRITRSRDQDHPSQHGDTPSLLKIQKLAGCGSRRL

SEQ ID NO: 2773 - protein, 148 aa, Homo sapiens
MDGTEGSAGQPGPAERSHRSSVSSVGARAADVLVYLADDTVVPLAVENLPSLSAHELHRAVREVLQLPDIALDVFALWLVSPLLEVQLKPKHQPYKLGRQWPELLLRFTSAPDDDVAMDEPFLQFRRNVFFPKRRELQIHDEEVLRLL

SEQ ID NO: 2774 - protein, 176 aa, Homo sapiens
MALLVVKQRMQMYNSPYHRVTGCVRAVWQNEGAGAFYRSYTTQLTMNVPFQAIHFMTYEFLQEHFNPQRRYNPSSHVLSGACAGAVAAAATTPLDVCKTLLNTQESLALNSHITGHITGMASAFRTVYQVGGVTAYFRGVQARVIYQIPSTAIAWSVYEFFKYLITKRQEEWRAGK

SEQ ID NO: 2775 - protein, 194 aa, Homo sapiens
MEDGLLEIMTKDGGDMPAPLEVSTVPAVGDVISGEYNGGMKELMEHLKAQLQALFEDVRAMRGALDEQASHIQVLSDDVCANQRAIVSMCQIMTTAPRQGGLGVVGGKGSFQSDPQEPETPSPGIGDSGLLGRDPEDEEEEEEEKEMPSPATPSSHCERPESPCAGLLGGDGPLVEPLDMPDITLLQLEGEASL

SEQ ID NO: 2776 - protein, 189 aa, Homo sapiens
MKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLDSHFVYSFSPVAGPNKLFIRLTEAPSAKVKLLIGAYRVQLQ

SEQ ID NO: 2777 - protein, 108 aa, Homo sapiens [sequence omitted]

SEQ ID NO: 2778 - protein, 541 aa, Homo sapiens
MPGLRRDRLLTLLLLGALLSADLYFHLWPQVQRQLRPRERPRGCPCTGRASSLARDSAAAASDPGTIVHNFSRTEPRTEPAGGSHSGSSSKLQALFAHPLYNVPEEPPLLGAEDSLLASQEALRYYRRKVARWNRRHKMYREQMNLTSLDPPLQLRLEASWVQFHLGINRHGLYSRSSPVVSKLLQDMRHFPTISADYSQDEKALLGACDCTQIVKPSGVHLKLVLRFSDFGKAMFKPMRQQRDEETPVDFFYFIDFQRHNAEIAAFHLDRILDFRRVPPTVGRIVNVTKEILEVTKNEILQSVFFVSPASNVCFFAKCPYMCKTEYAVCGKPHLLEGSLSAFLPSLNLAPRLSVPNPWIRSYTLAGKEEWEVNPLYCDTVKQIYPYNNSQRLLNVIDMAIFDFLIGNMDRHHYEMFTKFGDDGFLIHLDNARGFGRHSHDEISILSPLSQCCMIKKKTLLHLQLLAQADYRLSDVMRESLLEDQLSPVLTEPHLLALDRRLQTILRTVEGCIVAHGQQSVIVDGPVEQSAPDSGQANLTS

SEQ ID NO: 2779 - protein, 544 aa, Homo sapiens [sequence omitted]

SEQ ID NO: 2780 - protein, 853 aa, Homo sapiens
MGITSAVDDTTVFTSNPAFSETRRIPTEPTFSLTPGFRETSTSEETTSITETSAVLYGVPTSATTEVSMTEIMSSNRTHIPDSDQSTMSPDIITEVITRLSSSSMMSESTQMTITTQKSSPGATAQSTLTLATTTAPLARTHSTVPPRFLHSEMTTLMSRSPENPSWKSSPFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSTPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSAFNRESETTASLVSRSGAERSPVIQTLDVSSSEPDTTASWVIHLAETIPTVSKTTPNFFHSELDTVSSTATSHGADVSSAIPTNISPSELDALTPLVTISGTDTSTTFPTLTKSPHETETRTTWLTHPAETSSTIP

SEQ ID NO: 2781 - protein, 593 aa, Homo sapiens
MSVRLRFLSPGDTGAVGVVGRSASFAGFSSAQSRRIAKSINRNSVRSRMPAKSSKMYGTLRKGSVCADPKPQQVKKIFEALKRGLKEYLCVQQAELDHLSGRHKDTRRNSRLAFYYDLDKQTRCVERHIRKMEFHISKVDELYEDYCIQCRLRDGASSMQRAFARCPPSRAARESLQELGRSLHECAEDMWLIEGALEVHLGEFHIRMKGLVGYARLCPGDHYEVLMRLGRQRWKLKGRIESDDSQTWDEEEKAFIPTLHENLDIKVTELRGLGSLAVGAVTCDIADFFTTRPQVIVVDITELGTIKLQLEVQWNPFDTESFLVSPSPTGKFSMGSRKGSLYNWTPPSTPSFRERYYLSVLQQPTQQALLLGGPRATSILSYLSDSDLRGPSLRSQSQELPEMDSFSSEDPRDTETSTSASTSDVGFLPLTFGPHASIEEEAREDPLPPGLLPEMAHLSGGPFAEQPGWRNLGGESPSLPQGSLFHSGTASSSQNGHEEGATGDREDGPGVALEGPLQEVLELLRPTDSTQPQLRELEYQVLGFRDRLKPCRARQELTSAESLIECILESFAFLNADFAPDELSLFGGSQGLR

SEQ ID NO: 2782 - protein, 107 aa, Homo sapiens [sequence omitted]

SEQ ID NO: 2783 - protein, 170 aa, Homo sapiens
MATDFAENELDLFRKALELIIDSETGFASSTNILNLVDQLKGKKMRKKEAEQVLQKFVQNKWLIEKEGEFTLHGRAILEMEQYIRETYPDAVKICNICHSLLIQGQSCETCGIRMHLPCVAKYFQSNAEPRCPHCNDYWPHEIPKVFDPEKERESGVLKSNKKSLRSRQH

SEQ ID NO: 2784 - protein, 144 aa, Homo sapiens
MEGEPPPVEERRRLQEELNEFVESGCRTLEEVTASLGWDLDSLDPGEEEAAEDEVVICPYDSNHHMPKSSLAKHMASCRLRKMGYTKEEEDEMYNPEFFYENVKIPSITLNKDSQFQIIKQARTAVGKDSDCYNQIIGVSIKRN

SEQ ID NO: 2785 - protein, 288 aa, Homo sapiens
MHLTFRYAELELAWQKDVLEILNVISGARWPFFPLTIERLFFSVFSLCALLCVYNPAKGRTNMELREKFILADGASQGMAAFRPRGRRSRPSSRGASPNRSTSVSSQAAQAASPQVPATTTPKILHPLTRNYGKPWLTNSKMSTPCKAAECSDFPVPSAEGTPIQGSKLRLPGYLSGKGFHSGEDSGLITTAAARVRTQFADSKKTPSRPGSRAGSKAGSRASSRRGSDASDFDISEIQSVCSDVETVPQTHRPTPRAGSRPSTAKPSKIPTPQRKSPASKLDKSSKR

SEQ ID NO: 2786 - protein, 100 aa, Homo sapiens
MATVAELKAVLKDTLEKKGVLGHLKARIRAEVFNALDDDREPRPSLSHENLLINELIREYLEFNKYKYTASVLIADDHLRKEEQKSTNIEDLHVSQAVNR

SEQ ID NO: 2787 - protein, 105 aa, Homo sapiens
MRCYPRPVWTYCFLSLILNYQMMPMKCLKMILLSKLCFPRKVSCRALVLGDYDIPAVLVRSQSCFHLELMLPQGDICVTLLQGSVIKTMVTTSSLGSPRLQGTVS

SEQ ID NO: 2788 - protein, 128 aa, Homo sapiens
MLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 2789 - protein, 100 aa, Homo sapiens
MKNDKGDSTADPIEIQTTIREYYEHLYANKLENVEKMDKFLDTYTLPRLSQEEIESLNRPITSSEIEAVIKNLPAKKSPGPDGFTAEFYQSIKKSWYNVC

SEQ ID NO: 2790 - protein, 350 aa, Homo sapiens
MRLRTPKPGRRQSRPHAAADPNPDRPRPTRAAPSPKSQTPASPQGGPGSLRYSSFLRWPHPQLQTNQRRPNGLPKPSRWDPRSREPLPRPRPTATLGLRIRSAKCRGEGPTPPREPNSGNSPSSVHLHPDPPPRPQVHAPFRGDLSGASGPAETRGSDDRGPGGNRTACRSCLRGGCAALNCPRLFIPQPPAASDPPPAGAAQPFADAGELESDHAQPSHRGARFGPPTPFPGFITHFSPALKETSQMLLHSPTEAGLGCPQPRALPRTLQAPTGPLPATPRPIPKPALTLWGLHPLEEGRVKAWRCAACLTSAQGARQATGLSPDQRGPKGLIVKSAGPRTQGEDMLVL

SEQ ID NO: 2791 - protein, 283 aa, Homo sapiens [sequence omitted]

SEQ ID NO: 2792 - protein, 157 aa, Homo sapiens [sequence omitted]

SEQ ID NO: 2793 - protein, 191 aa, Homo sapiens
MEHANHMAAQPQFVHPEHRSFVDLSGHNLANPHPFAVVPSTATVVIVVCVSFLVFMIILGVFRIRAAHRRTMRDQDTGKENEMDWDDSALTITVNPMEVGVGGRPPGLRGSTGQGLREAGTARLLQTYEDQHSSEEEEEEEEEEESEDGEEEDDITSAESESSEEEEGEQGDPQNATRQQQLEWDDSTLSY

SEQ ID NO: 2794 - protein, 728 aa, Homo sapiens [sequence omitted]

SEQ ID NO: 2795 - protein, 125 aa, Homo sapiens
MCVWGVGVGSGLSGFGRGLGRVRGGWRMKSPTPFPSSRPQKPGKGGCLLSLLCVLQMCQNGGGWEGRVPGRAAPGVALSKQYSSPAGDSKTGERVGVGTWGFPMYSYVYSGVFSVWYPLWASMCV

SEQ ID NO: 2796 - protein, 745 aa, Homo sapiens
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTDAAWTVVQHGGPDAVTLRGAPSGHPRSAVSFAYAAGAGQLRSAVNLAERCEQRLALRCGTARRPDSRGGTPLSWWVGRTNETHTYWGVSLPDAQKCTCGLEGNCIDSQYYCNCDAGRNEW

SEQ ID NO: 2797 - protein, 128 aa, Homo sapiens [sequence omitted]

SEQ ID NO: 2798 - protein, 129 aa, Homo sapiens
MRVAGPCICLLPCTGVPLAASAHQCHGILSEDENSPCFFARMAELSWKGSWTQATADYRRLPGAVQMWEEEGPWCTLAFLPDCNVALCQLPPLSRPQENGEKAALKVAVTREGAEGLTVNHALYFPVLP

SEQ ID NO: 2799 - protein, 128 aa, Homo sapiens
MPGGLGGCFSNRPAENSCIMICPAVSHLPALNSSGSSGCGGLDILTTSFVHPPPPPPPQFAYLGRLAHEVGWKYQAVTATLEEKRKEKAKIHYRKKKQLMRLRKQAEKNVEKKIDKYTEVLKTHGLLV

SEQ ID NO: 2800 - protein, 410 aa, Homo sapiens
MEDPSGAREPRARPRERDPGRRPHPDQGRTHDRPRDRPGDPRRKRSSDGNRRRDGDRDPKRDQERDGNRDRNRDRERERERERDPDRGPRRDTHRDAGPRAGEHGVWEKPRQSRTRDGARGLTWDAAAPPGPAPWEAPEPPQPQRKGDPGRRRPESEPPSERYLPSTPRPGREEVEYYQSEAEGLLECHKCKYLCTGRGVVQIVEVVLNGMVLICIVASYFVLAGFSASFSSGGGFGNNYYSPFEGTELEQVRQLDQQYTILRSPLIYGGVAVSLGLGVLTMGVLLQGAKSRTMLSGKWLLTEAAFSLLAAVGYCTGIGVYLHVALQINSTDTCKTRERLYARKGLTWMDCQLAGTDGAAATFACLLVIMYGASVVLALRSYREQKRHKGSREQPGSYSDAPEYLWSGTL

SEQ ID NO: 2801 - protein, 144 aa, Homo sapiens [sequence omitted]

SEQ ID NO: 2802 - protein, 116 aa, Homo sapiens
MKECLLQGKCYHYYSSGFTECCHVQVPRNVPSVHYLIYPTELSCMESMLSVLIYKGRDPDQARWLRPVIPALWEDPCSRLQLQREHRPGISPLCCQQGMTGASIRLQSGSQGAAGG

SEQ ID NO: 2803 - protein, 135 aa, Homo sapiens
MSAQGLRPRTVSSPIPYTPSPSSSRPISPGLSYASHTVGFTPPTSLTRAGMSYYNSPGLHVQHMGTSHGITRPSPRRSNSPDKFKRPTPPPSPNTQTPVQPPPPPPPPPMQPTVPSAATSQPTPSQHSAHTSSQP

SEQ ID NO: 2804 - protein, 117 aa, Homo sapiens [sequence omitted]

SEQ ID NO: 2805 - protein, 289 aa, Homo sapiens
MQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYGLGSYSPAPPGCGPHFVYSLMVRLSSDVA

SEQ ID NO: 2806 - protein, 106 aa, Homo sapiens
MRLVQGEAVCCVPGPATSWRACAGTWSCPTWAAACVCDCTVATLAHTPLAHPSAPPVSISLGSGIQVGSKCEWAEAAQWAQSKTQAKVPLDWPGKRHPKDPIMLIC

SEQ ID NO: 2807 - protein, 127 aa, Homo sapiens
MTVCGFLVCLFVGLRKGEAKVPSLREAMEKVPSQGSVPHGAVRLKGLTGSSPHRTPPHLKPSFSATIQGTRSPELSKTHSGRKPSQAVTEGLWSGLERVFLSDTSRGQHSTESHRHLPAFPPQTLGG

SEQ ID NO: 2808 - protein, 142 aa, Homo sapiens; identical to SEQ ID NO: 2751

SEQ ID NO: 2809 - protein, 452 aa, Homo sapiens
MATSLLGEEPRLGSTPLAMLAATCNKIGSPSPSPSSLSDSSSSFGKGFHPWKRSSSSSSASCNVVGSSLSSFGVSGASRNGGSSSAAAAAAAAAAAAAALVSDSFSCGGSSAHSQDGSHQPVFISKVHTSVDGLQGIYPRVGMAHPYESWFKPSHPGLGAAGEVGSAGASSWWDVGAGWIDVQNPNSAAALPGSLHPAAGGLQTSLHSPLGGYNSDYSGLSHSAFSSGASSHLLSPAGQHLMDGFKPVLPGSYPDSAPSPLAGAGGSMLSAGPSAPLGGSPRSSARRYSGRATCDCPNCQEAERLGPAGASLRRKGLHSCHIPGCGKVYGKTSHLKAHLRWHTGERPFVCNWLFCGKRFTRSDELQRHLRTHTGEKRFACPVCNKRFMRSDHLSKHVKTHSGGGGGGGSAGSGSGGKKGSDTDSEHSAAGSPPCHSPELLQPPEPGHRNGLE

SEQ ID NO: 2810 - protein, 309 aa, Homo sapiens
MFYANFSRRTGPAPPLRTTPRAWLRRECGASTMSAPGSPDQAYDFLLKFLLVGDRDVGKSEILESLQDGAAESPYSHLGGIDYKTTTILLDGQRVKLKLWDTSGQGRFCTIFRSYSRGAQGVILVYDIANRWSFEGMDRWIKKIEEHAPGVPKILVGNRLHLAFKRQVPREQAQAYAERLGVTFFEVSPLCNFNIIESFTELARIVLLRHRMNWLGRPSKVLSLQDLCCRTIVSCTPVHLVDKLPLPSTLRSHLKSFSMAKGLNARMMRGLSYSLTTSSTHKSSLCKVEIVCPPQSPPKNCTRNSCKIS

SEQ ID NO: 2811 - protein, 102 aa, Homo sapiens [sequence omitted]

SEQ ID NO: 2812 - protein, 159 aa, Homo sapiens
MVPASAPADHRRLAPDSLSACSSRTDTASLATSCPSRPSRVSTTQMRPLKGTGCPGITTWYQKRCQPAGPMPKHLVRNTGLPSFIRWHSNCRVARAPWNPNLSLAKANWLPSGCGDRKKGPTSCWRSRCFRSGLSHSTATCSPQRCDCPVGKMQRQGQV

SEQ ID NO: 2813 - protein, 182 aa, Homo sapiens [sequence omitted]

SEQ ID NO: 2814 - protein, 104 aa, Homo sapiens
MSVPMALPRVMLLIWSDSQAGGNGVCPALVLLPDGEHAQFPAFRYEQRLGRIRPVQSCRKSPGCLSQIGISGREPQAGTETRYCCVVQAGHRLLAASDPPASAS

SEQ ID NO: 2815 - protein, 366 aa, Homo sapiens
MYVYTLKACCKNKMPNIFLVSDIFPRALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRSRASSESQGLGAGVRTEADVEEEALRRKLEELTSNVSDQETSSEE

SEQ ID NO: 2816 - protein, 144 aa, Homo sapiens [sequence omitted]

SEQ ID NO: 2817 - protein, 203 aa, Homo sapiens
MEPAAALHFSRPASLLLLLSLCALVSAQVTVVGPTDPILAMVGENTTLRCCLSPEENAEDMEVRWFQSQFSPAVFVYKGGRERTEEQKEEYRGRTTFVSKDSRGSVALIIHNVTAEDNGIYQCYFQEGRSCNEAILHLVVAGALLHFALLLWHCVTLGKASLLNSSPLQTSTILFPGSPFRRDTLPMKRRFQGKILPPAQGPP

SEQ ID NO: 2818 - protein, 478 aa, Homo sapiens
MGQCYNLEDDDLETDVNKLSSKPGLDRPEEELMQYEVMCLELSYSFEELQSKLGDDLNSEKTQYANHHHIPAAASSKQHCYSKDQSSCGQEREYAVQTSLLCRVKTGRSTVHLGSKKNPGVNLYQNVQSNSLRRDSSESEIPDIQASPKADAWDVDAIFCPRMSASFSNSTRTREVAKVIDKLLQTHLKRVPFHDPYLYMAKARRTSSVVDFKMMAFPDVWGHCPPPTTQPMLERKCGVQRIRIFEDIRRLIQPGDVINKVVFSLDEPWPLQDNASNCLRFFSKFESGNLRKAIQVREFEYDLLVNADVNSTQHQQWFYFKVSGMQAAIPYHFNIINCEKPNSQFNYGMQPTLYSVKEDLLGKPTWIRTGHEICYYKNHYRQSTAVAGGASGKCYYTLTFAVTFPHSEDVCYLAYHYPYTYTALMTHLDILEKSVNLKEVYFRQDVLCQTLGGNPCPLVTITAMPESNSDEHLEQFRE

SEQ ID NO: 2819 - protein, 471 aa, Homo sapiens
MLGSWGCYRYAKLFSCSLSTHARFIKILDSVLHHLVPAWDHTLGTFSEIKQVKQFLLLSRQRPGLVAQCLRDSESSKPSFMPRLYINRRLAMEHRACPSRDPACKNAVFTQVYEGLKPSDKYEKPLDYRWPMRYDQWWECKFIAEGIIDQGGGFRDSLADMSEELCPSSADTPVPLPFFVRTANQGNGTGEARDMYVPNPSCRDFAKYEWIGQLMGAALRGKEFLVLALPGFVWKQLSGEEVSWSKDFPAVDSVLVKLLEVMEGMDKETFEFKFGKELTFTTVLSDQQVVELIPGGAGIVVGYGDRSRFIQLVQKARLEESKEQVAAMQAGLLKVVPQAVLDLLTWQELEKKVCGDPEVTVDALRKLTRFEDFEPSDSRVQYFWEALNNFTNEDRSRFLRFVTGRSRLPARIYIYPDKLGYETTDALPESSTCSSTLFLPHYASAKVCEEKLRYAAYNCVAIDTDMSPWEE

SEQ ID NO: 2820 - protein, 529 aa, Homo sapiens
MFPLTEENKHVAQLLLNTGTCPRCIFRFCGVDFHAPYKLPYKELLNELQKFLETEKDELILEVMNPPPKKIRLQELEDSIDNLSQNGEGRISVSHVGSTASKNSNLNVCNVCLGILQEFCEKDFIKKVCQKVEASGFEFTSLVFSVSFPPQLSVREHAAWLLVKQEMGKQSLSLGRDDIVQLKEAYKWITHPLFSEELGVPIDGKSLLEVSVVFAHPETVEDCHFLAAICPDCFKPAKNKQSVFTRMAVMKALNKIKEEDFLKQFPCPPNSPKAVCAVLEIECAHGAVFVAGRYNKYSRNLPQTPWIIDGERKLESSVEELISDHLLAVFKAESFNFSSSGREDVDVRTLGNGRPFAIELVNPHRVHFTSQEIKELQQKINNSSNKIQVRDLQLVTREAIGHMKEGEEEKTKTYSALIWTNKAIQKKDIEFLNDIKDLKIDQKTPLRVLHRRPLAVRARVIHFMETQYVDEHHFRLHLKTQAGTYIKEFVHGDFGRTKPNIGSLMNVTADILELDVESVDVDWPPALDD

SEQ ID NO: 2821 - protein, 155 aa, Homo sapiens
MPEDSRVGGSASQGPGSARRLGENAGPAEAHTRGPPRLPAATGCPPHLPGLLSGISVDIDPTGLQSQWTPKGQDPPLMFSEDYQKSLLEQYHLGLDQKLRKYVVGELIWNFADFMTNQCQPKTTPSVILFLPSCEEPQANKATLVCLMNNFIRES

SEQ ID NO: 2822 - protein, 118 aa, Homo sapiens [sequence omitted]

SEQ ID NO: 2823 - protein, 106 aa, Homo sapiens
MWVHRCQELRFRNLCLDFRRCVETPGCPGKSLLQGQVPHQETLLGQCRREIWGWSPPHRVPTGALPSGAARRKPLSSRPQNDRSTDSLHCVPGKAADKLQTLNASP

SEQ ID NO: 2824 - protein, 501 aa, Homo sapiens
MAQPHTTSVPYFARSPAPPPPSRSGAPPQPPATLRPSRRRTRPPRPADRRDAPADCAYLWRILTPRRGRARRSDVGARHRACGRRDVLLSRQGPANPEGARRVVGGQERVWPAVRRGRGGSMFRLLSWSLGRGFLRAAGRRCRGCSARLLPGLAGGPGPEVQVPPSRVAPHGRGPGLLPLLAALAWFSRPAAAEEEEQQGADGAAAEDGADEAEAEIIQLLKRAKLSIMKDEPEEAELILHDALRLAYQTDNKKAITYTYDLMANLAFIRGQLENAEQLFKATMSYLLGGGMKQEDNAIIEISLKLASIYAAQNRQEFAVAGYEFCISTLEEKIEREKELAEDIMSVEEKANTHLLLGMCLDACARYLLFSKQPSQAQRMYEKALQISEEIQGERHPQTIVLMSDLATTLDAQGRFDEAYIYMQRASDLARQINHPELHMVLSNLAAVLMHRERYTQAKEIYQEALKQAKLKKDEISVQHIREELAELSKKSRPLTNSVKL

SEQ ID NO: 2825 - protein, 117 aa, Homo sapiens [sequence omitted]

SEQ ID NO: 2826 - protein, 494 aa, Homo sapiens
MDSEYYSGDQSDDGGATPVQNDSFHSDSHMDRKKFHSSDSEEEEHKKQKMDSDEDEKEGEEEKVAKRKAAVLSDSEDEEKASAKKSRVVSDADDSDSDAVSDKSGKREKTIASDSEEEAGKELSDKKNEEKDLFGSDSESGNEEENLIADIFGESGDEEEEEFTGFNQEDLEEEKGETQVKEAEDSDSDDNIKRGKHMDFLSDFEMMLQRKKSMSGKRRRNRDGGTFISDADDVVSAMIVKMNEAAEEDRQLNNQKKPALKKLTLLPAVVMHLKKQDLKETFIDSGVMSAIKEWLSPLPDRSLPALKIREELLKILQELPSVSQETLKHSGIGRAVMYLYKHPKESRSNKDMAGKLINEWSRPIFGLTSNYKGMTREEREQRDLEQMPQRRRMNSTGGQTPRRDLEKVLTGEEKALRPGDPGFCARARVPMPSNKDYVVRPKWNVEMESSRFQATSKKGISRLDKQMRKFTDIRKKSRSAHAVKISIEGNKMPL

SEQ ID NO: 2827 - protein, 137 aa, Homo sapiens
MDGASHLHVLVVKEYEMAIYKKYWPNHIMLVLPSIFNSAGVGAAHFLIKELSYHNLELERNRQEELGIKPQDIWPFIVISDDSCVMWNVVDVNSAGITGVSHRACPRMVFKATVERPPIARRLDSDHLVHLVQSFLV

SEQ ID NO: 2828 - protein, 208 aa, Homo sapiens [sequence omitted]

SEQ ID NO: 2829 - protein, 521 aa, Homo sapiens
MGQQRKEGMAVCFPCGCLEARLSDVPDSCSALAPGSRGCTRACGATAHQSGGGGPSCTAGTPGVSCPSALALPCLLFRVHVLELTADVFSLHVQLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSADVEVARF

SEQ ID NO: 2830 - protein, 143 aa, Homo sapiens
MTMVVFSSHFLNFFFFVLLLVFLLCSFLTFLPPHNLACAIPVTITNSRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 2831 - protein, 105 aa, Homo sapiens
MASGSWQEDNNARRGWAESCASSQGPGCSGQGQGGSFCGHRCPAPGGGPATGLARWPQALRTQGRPRIYGKEGAEHLSLGTSRDRHCPQQPQLPPIKGTDAAPCL

SEQ ID NO: 2832 - protein, 270 aa, Homo sapiens
MHLNGRCICPSDPQFVEEKGIRAEDLVIGALESAFQECDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRYCSCWGPAWAWVGASSKPK

SEQ ID NO: 2833 - protein, 154 aa, Homo sapiens
MGGQRELGAEMELDVIGLCSQLEVSFPPSLHTERNLCSLALTAGLWHLVTSILVLALHRGRFFFTLQHCWASLPSHGSVGEICYAVPPSGRLVLRGALLQRRQPSICGELAKIQSDLLRAPQRPSLFGAVSLGSLSECTFYLKYTNTKSQLSWF

SEQ ID NO: 2834 - protein, 298 aa, Homo sapiens
MATLGHTFPFYAGPKPTFPMDTTLASIIMIFLTALATFIVILPGIRGKTRLFWLLRVVTSLFIGAAILGTPVQQLNETINYNEEFTWRLGENYAEEYAKALEKGLPDPVLYLAEKFTPRSPCGLYRQYRLAGHYTSAMLWVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYCKEAHPKDPDCAL

SEQ ID NO: 2835 - protein, 105 aa, Homo sapiens
MLKYEVNLQISLAQYRKSPFLPSAMHPMQVCRVSAVRCPSGTQAEEAPLSYLATSSAHGSGFSRQGVEQRLFSAGPGCDIRCFCSQPCGQNKSHHPSYLQGCWAA

SEQ ID NO: 2836 - protein, 104 aa, Homo sapiens
MSSLQRDLLGPPPPFSILFLSFIFFEALTHFQKLSGLLMCLSLDCLLPLLDCTLHKRAKLCLLHSLLSSQKQAACWRPSNTCEMKGHLVLFHLFPPGSQVASLH

SEQ ID NO: 2837 - protein, 129 aa, Homo sapiens [sequence omitted]

SEQ ID NO: 2838 - protein, 105 aa, Homo sapiens
MGRPHLCKKSYQKKKRCSKNSVLLYYGTTIICVVHLLTETSSWRHMTVFVYLEIFFVLSVYFVMNVPLLCFKVTQNNSSLWFLSPTGYTVRCFCFILFWSFGGDI

SEQ ID NO: 2839 - protein, 128 aa, Homo sapiens
MLAAAPSGGHRQCQSLAPPCSPALCRCSRRARSSAPNSRSGVRSRQHPSSAAAATAVLSSRHWLPKLSSTRDLSGTPRRRGRGGPGAARGCSGAPGSFRPPHGRASQAALLREAQNTARYAPPPQLRC

SEQ ID NO: 2840 - protein, 740 aa, Homo sapiens
MTVDFMSVKTVSSSSLKAEKETMRKIEQEKNQALEQSKLMERELNPYWKDGGTGLPPEDCSVSSITKVSVVEDGGLSWLRKSYLRMKEQAEKQSRNFEDIVAERYGSMEIFQSKLEDAEKAASTKEDYRRERWRKPTYSDKAQNCQESRESDLVKYGNSSRDRYATTDTAKNSNNEKFIGDEKDKRPGSLETCRRESNPRQNQEFSFGNLRAKFLRPSDDEELSFHSKGRKFEPLSSSSALVAQGSLCSGFRKPTKNSEERLTSWSRSDGRGDKKHSNQKPSETSTDEHQHVPEDPREKSQDEVLRDDPPKKEHLRDTKSTFAGSPERESIHILSVDEKNKLGAKIIKAEMMGNMELAEQLKVQLEKANKFKETITQIPKKSGVENEDQQEVILVRTDQSGRVWPVNTPGKSLESQGGRRKRQMVSTHEERERVRYFHDDDNLSLNDLVKNEKMGTAENQNKLFMRMASKFMGKTDGDYYTLDDMFVSKAAERERLGEEEENQRKKAIAEHRSLAAQMEKCLYCFDSSQFPKHLIVAIGVKVYLCLPNVRSLTEGHCLIVPLQHHRAATLLDEDIWEEIQMFRKSLVKMFEDKGLDCIFLETNMSMKKQYHMVYECIPLPKEVGDMAPIYFKKAIMESDEEWSMNKKLIDLSSKDIRKSVPRGLPYFSVDFGLHGGFAHVIEDQHKFPHYFGKEIIGGMLDIEPRLWRKGIRESFEDQRKKALQFAQWWKPYDFTKSKNY

SEQ ID NO: 2841 - protein, 106 aa, Homo sapiens
MCDFWDKIWNFQAKPDDLLIASYPKAGTTWTQEIVDLIQNDGDIEKSRRASIQLQHPFLEWIRMTHCGIDQANTMPSPRTLKTHLPVQLLPPSFWEENCKCPRGRI

SEQ ID NO: 2842 - protein, 241 aa, Homo sapiens [sequence omitted]

SEQ ID NO: 2843 - protein, 735 aa, Homo sapiens
MAAAAGQDGGGGGGADEDDDGEDGDEGEEEEEACPEPSPLCPVPAGGGFYLVPTFSLPPAPGRLERLGRVMVELEALLPPPGAVPGGAGVWVPGGRPPVLRGLVRVLNRSFEKAVHVRASHDGWASFCDHPARYVPRSPPWAGAGGTGAGDPILDPGLGLGPGQASASSPDDGGRTDRFAFQLPFAEGAGDGARLDFVVRYETPEGTFWANNHGRNYTVLLRIAPAPTPTDAEGLPQQQQLPQLEPQPECQGPVEAEARQLKSCMKPVRRRPAEEELKTKNMDDNTFAMAEHPDVQESVGPLVAPTPLRPWPHMTLQVSDVPMTGNPAEEGDVPRSSPPVAFTEVLQAPAIRIPPSSPLCGLGGSPRDQASGPDASEGATGPFLEPSQQQAEATWGVSSENGGGLEAVSGSEELLGEDTIDQELEQLYLSHLSRLRAAVAAGGAGGGGEGSTDGGMSPSHPLGILTDRDLILKWPGPERALNSALAEEITLHYARLGRGVELIKDTEDPDDEGEGEEGLSVTPSSPEGDSPKESPPEILSGARSVVATMGDVWLPWAEGSGCDGPVVLGTEGQFIGDPEKGMGKDTSSLHMNRVIAGVTESLGEAGTEAQIEVTSEWAGSLDPISGKEPASPVLLQGQNPTLLSPLGAEVCLSSVARPHVSSQDEKDAGPSLEPPKKSPTLAVPAECVCALPPQLRGPLTQTLGVLAGLVVVPVALNSGVSLLVLALCLSLAWFS

SEQ ID NO: 2844 - protein, 705 aa, Homo sapiens [sequence omitted]

SEQ ID NO: 2845 - protein, 322 aa, Homo sapiens
MTLYPLHWQEEMSGESVVSSAVPAAATRTTSFKGTSPSSKYVKLNVGGALYYTTMQTLTKQDTMLKAMFSGRMEVLTDSEGWILIDRCGKHFGTILNYLRDGAVPLPESRREIEELLAEAKYYLVQGLVEECQAALQQNKDTYEPFCKVPVITSSKEEQKLIATSNKPAVKLLYNRSNNKYSYTSNSDDNMLKNIELFDKLSLRFNGRVLFIKDVIGDEICCWSFYGQGRKIAEVCCTSIVYATEKKQTKVEFPEARIYEETLNILLYEAQDGRGPDNALLEATGGAAGRSHHLDEDEERERIERVRRIHIKRPDDRAHLHQ

SEQ ID NO: 2846 - protein, 579 aa, Homo sapiens
MTRLERSSHRTVICKVPGELVAREGKCASRARESEIPSEEGYCDFNSRPNENSYCYQLLRQLNEQRKKGILCDVSIVVSGKIFKAHKNILVAGSRFFKTLYCFSNKESPNQNNTTHLDIAAVQGFSVILDFLYSGNLVLTSQNAIEVMTVASYLQMSEVVQTCRNFIKDALNISIKSEAPESVVVDYNNRKPVNRDGLSSSRDQKIASFWATRNLTNLASNVKIENDGCNVDEGQIENYQMNDSSWVQDGSPEMAENESEGQTKVFIWNNMGSQGIQETGKTRRKNQTTKRFIYNIPPNNETNLEDCSVMQPPVAYPEENTLLIKEEPDLDGALLSGPDGDRNVNANLLAEAGTSQDGGDAGTSHDFKYGLMPGPSNDFKYGLIPGTSNDFKYGLIPGASNDFKYGLLPESWPKQETWENGESSLIMNKLKCPHCSYVAKYRRTLKRHLLIHTGVRSFSCDICGKLFTRREHVKRHSLVHKKDKKYKCMVCKKIFMLAASVGIRHGSRRYGVCVDCADKSQPGGQEGVDQGQDTEFPRDEEYEENEVGEADEELVDDGEDQNDPSRWDESGEVCMSLDD

SEQ ID NO: 2847 - protein, 100 aa, Homo sapiens [sequence omitted]

SEQ ID NO: 2848 - protein, 126 aa, Homo sapiens
MQKQRPREMNSLPGVPQPQPQSLPLPPSLPSALAPVPSLPSAPAPVPALPLPRRPSALPPKENGCAVWSTEATFRPGPEPPPPPPRRRASAPHGPLDMAPFARLHECYGQEIRALRGQWLSSRVQP

SEQ ID NO: 2849 - protein, 223 aa, Homo sapiens
MAGITTIEAVKRKIQVLQQQADDAEERAERLQREVEGERRAQERLATALQKLEEAEKAADESERGMKVIENRALKDEEKMELQEIQLKEAKHIAEEADRKYEEVARKLVIIEGDLERTEERAELAESRCREMDEQIRLMDQNLKCLSAAEEKYSQKEDKYEEEIKILTDKLKEAETRAEFAERSVAKLEKTIDDLEDKLKCTKEEHLCTQRMLDQTLLDLNEM

SEQ ID NO: 2850 - protein, 756 aa, Homo sapiens
MARSSSLGRECGTPRSGLGKGGPPRPQGPQARCTLGRRCTVSGKCRRPRPSWTMAPPRNVVKIAIKMRDAIPQLIQLDQAKPLAAVLKEVCDAWSLTHSERYALQFADGHRRYITENDLEAEQLLGGLQSNSPEGRREALRRLVPLASDMIFAREVISRNGLQILGTIIEDGDDLGEVLALSLRAFSELMEHGVVSWETLSIPFVRKVVCYVNMNLMDASVPPLALGLLESVTLSSPALGQLVKSEVPLDRLLVHLQVMNQQLQTKAMALLTALLQGASPVERKHMLDYLWQRNLRQFIYKNIIHSAAPMGDEMAHHLYVLQALMLGLLEPRMRTPLDPYSQEQREQLQVLCQAAFEVEGESSGAGLSADRRRSLCAREFRKLGFSNSNPAQDLERVPPGLLALDNMLYFSRNAPSAYSRFVLENSSREDKHECPFARGSIQLTVLLCELLRVGEPCSETAQDFSPMFFGQDQSFHELFCVGIQLLNKTWKEMRATQEDFDKVMQVVREQLARTLALKPTSLELFRTKVNALTYGEVLRLRQTERLHQEGTLAPPILELREKLKPELMGLIRQQRLLRLCEGTLFRKIGSRRRQDKLWFCCLSPNHKLLQYGDMEEGASPPTLESLPEQLPVADMRALLTGKDCPHVREKGSGKQNKDLYELAFSISYDRGEEEAYLNFIAPSKREFYLWTDGLSALLGSPMGSEQTRLDLEQLLTMETKLRLLELENVPIPERPPPVPPPPTNFNFCYDCSIAEP

SEQ ID NO: 2851 - protein, 697 aa, Homo sapiens
MGFQPPAALLLRLFLLQGILRLLWGDLAFIPPFIRMSGPAVSASLVGDTEGVTVSLAVLQDEAGILPIPTCGVLNNETEDWSVTVIPGAKVLEVTVRWKRGLDWCSSNETDSFSESPCILQTLLVSASHNSSCSAHLLIQVEIYANSSLTHNASENVTVIPNQVYQPLGPCPCNLTAGACDVRCCCDQECSSNLTTLFRRSCFTGVFGGDVNPPFDQLCSAGTTTRGVPDWFPFLCVQSPLANTPFLGYFYHGAVSPKQDSSFEVYVDTDAKDFADFGYKQGDPIMTVKKAYFTIPQVSLAGQCMQNAPVAFLHNFDVKCVTNLELYQERDGIINAKIKNVALGGIVTPKVIYEEATDLDKFITNTETPLNNGSTPRIVNVEEHYIFKWNNNTISEINVKIFRAEINAHQKGIMTQRFVVKFLSYNSGNEEELSGNPGYQLGKPVRALNINRMNNVTTLHLWQSAGRGLCTSATFKPILFGENVLSGCLLEVGINENCTQLRENAVERLDSLIQATHVAMRGNSDYADLSDGWLEIIRVDAPDPGADPLASSVNGMCLDIPAHLSIRILISDAGAVEGITQQEILGVETRFSSVNWQYQCGLTCEHKADLLPISASVQFIKIPAQLPHPLTRFQINYTEYDCNRNEVCWPQLLYPWTQYYQGELHSQCVAKGLLLLLFLTLALFLSNPWTRICKAYS

SEQ ID NO: 2852 - protein, 638 aa, Homo sapiens
MAAELRMILYEDDSVQVQYVDGSTLQLSPCGSEFLFEKSPPVSAHPLEQPERIRQRTHFVISTYREQLQRALDFRNSSATCPFLSETIIPSERKKHIFIDITEVRWPSLDTDGTMIYMESGIVKITSLDGHAYLCLPRSQHEFTVHFLCKVSQKSDSSAVLSETNNKAPKDKLVEKTGKICIRGNLPGQRLKNKENEFHCQIMKSKETLKKMSCVNGTEGREELPSPGTKHTCVYTWVKQCWSVAACPEEWKYPLSLALHFHNKISNMSKIDAHITQSRFLTSDISEERGKVVSVLPRALSLSCPVPHLHRWNFCDSLLQRQSDEYSYPELVKMVWYKGVTYRLTHQNMNSIEIYSGDGSVFKSEGAYFGNYFTYYSIQEGSGKREEKTYSVNNLPPDRPGSPFTVGSLIKQATRILQHCVKMRLSLSHNYRICCWKMVPGINDSNILPLVLKESLIPSVGRFLAYSDDKVHAIFLDGITLTLNWNFSSPIEKRQVNQGLNLGWCKLTFPDGQEQLIQIEHPEPYERYVTTVTSWCRRLTQTSPREMPTHSSSSVLQENWSVASELEKIQKFNLLLENSGILNQISNKKNEQQSFDHYKPGSSETLLGEVNENRVSIALKKTSEILHDIDCLLSNSKK

SEQ ID NO: 2853 - protein, 1070 aa, Homo sapiens
MLLNGTPFAFVIDLAALASRREYLKLDKWLTDKIREHGEPFIQACMTFLKRRCPSILGGLAPEKDQPKSAQLPPETLATMLACLQACAGSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQSKMKPSDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEKLFQSVAQCCMGQKQAQQVMEGTGAS

SEQ ID NO: 2854 - protein, 257 aa, Homo sapiens
MIDKNQTCGVGQDSVPYMICLIHILEEWFGVEQLEDYLNFANYLLWVFTPLILLILPYFTIFLLYLTIIFLHIYKRKNVLKEAYSHNLWDGARKTVATLWDGHAAVWHGYEVHGMEKIPEDGPALIIFYHGAIPIDFYYFMAKIFIHKGRTCRVVADHFVFKIPGFSLLLDVFCALHGPREKCVEILRSGHLLAISPGGVREALISDETYNIVWGHRRGFAQVAIDAKVTKNAVQALIDKHQRIPGNIMSALLERFH

SEQ ID NO: 2855 - protein, 211 aa, Homo sapiens
MEEPPVREEEEEEGEEDEERDEVGPEGALGKSPFQLTAEDVYDISYLLGRELMALGSDPRVTQLQFKVVRVLEMLEALVNEGSLALEELKMERDHLRKEVEGLRRQSPPASGEVNLGPNKMVVDLTDPNRPRFTLQELRDVLQERNKLKSQLLVVQEELQCYKSGLIPPREGPGGRREKDAVVTSAKNAGRNKEEKTIIKKLFFFRSGKQT

SEQ ID NO: 2856 - protein, 202 aa, Homo sapiens
MAAAAGAAAAAAAEGEAPAEMGALLLEKETRGATERVHGSLGDTPRSEETLPKATPDSLEPAGPSSPASVTVTVGDEGADTPVGATPLIGDESENLEGDGDLRGGRILLGHATKSFPSSPSKGGSCPSRAKMSMTGAGKSPPSVQSLAMRLLSMPGAQGAAAAGSEPPPATTSPEGQPKVHRARKTMSKPGNGQVSGMGEMG

SEQ ID NO: 2857 - protein, 116 aa, Homo sapiens
MRGVAEVKEPCSLPMLSVDMENKENGSVGVKNSMENGRPPDPADWAVMDVVNYFRTVGFEEQASAFQEQEIDGKSLLLMTRNDVLTGLQLKLGPALKIYEYHVKPLQTKHLKNNSS

SEQ ID NO: 2858 - protein, 337 aa, Homo sapiens
MNPESSIFIEDYLKYFQDQVSRENLLQLLTDDEAWNGFVAAAELPRDEADELRKALNKLASHMVMKDKNRHDKDQQHRQWFLKEFPRLKRELEDHIRKLRALAEEVEQVHRGTTIANVVSNSVGTTSGILTLLGLGLAPFTEGISFVLLDTGMGLGAAAAVAGITCSVVELVNKLRARAQARNLDQSGTNVAKVMKEFVGGNTPNVLTLVDNWYQVTQGIGRNIRAIRRARANPQLGAYAPPPHVIGRISAEGGEQVERVVEGPAQAMSRGTMIVGAATGGILLLLDVVSLAYESKHLLEGAKSESAEELKKRAQELEGKLNFLTKIHEMLQPGQDQ

SEQ ID NO: 2859 - protein, 388 aa, Homo sapiens
MQIFVKTLTGKTITLEVEPSDTIENVKAKIQDKEGIPPDQQRLIFAGKQLEDGRTLSDYNIQKEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDTIENVKAKIQDKEGIPPDQQRLIFAGKQLEDGRTLSDYNIQKESTLHLVLRLRGGV

SEQ ID NO: 2860 - protein, 421 aa, Homo sapiens [sequence omitted]

SEQ ID NO: 2861 - protein, 353 aa, Homo sapiens
MDYKSSLIQDGNPMENLEKQLICPICLEMFTKPVVILPCQHNLCRKCANDIFQAANPYWTSRGSSVSMSGGRFRCPTCRHEVIMDRHGVYGLQRNLLVENIIDIYKQECSSRPLQKGSHPMCKEHEDEKINIYCLTCEVPTCSMCKVFGIHKACEVAPLQSVFQGQKTELNNCISMLVAGNDRVQTIITQLEDSRRVTKENSHQVKEELSQKFDTLYAILDEKKSELLQRITQEQEKKLSFIEALIQQYQEQLDKSTKLVETAIQSLDEPGGATFLLTAKQLIKSIVEASKGCQLGKTEQGFENMDFFTLDLEHIADALRAIDFGTDEEEEEFIEEEDQEEEESTEGKEEGHQ

SEQ ID NO: 2862 - protein, 286 aa, Homo sapiens
MMATPNQTACNAESPVALEEAKTSGAPGSPQTPPERHDSGGSLPLTPRMESHSEDEDLAGAVGGLGWNSRSPRTQSPGGCSAEAVLARKKHRRRPSKRKRHWRPYLELSWAEKQQRDERQSQRASRVREEMFAKGQPVAPYNTTQFLMNDRDPEEPNLDVPHGISHPGSSGESEAGDSDGRGRAHGEFQRKDFSETYERFHTESLQGRSKQELVRDYLELEKRLSQAEEETRRLQQLQACTGQQSCRQVEELAAEVQRLRTENQRLRQENQMWNREGCRCDEEPGT

SEQ ID NO: 2863 - protein, 258 aa, Homo sapiens
MRQMIRSFSEPFGRDLLSISDGRGRAHNRRGHNDGEDSLTATSCSLVPFGDFGGMHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 2864 - protein, 345 aa, Homo sapiens
MANEVMEDPGQGSSMARMEASQPAPKGNFPSMPLVGEGDRVKAPPDAAPGLVASNCKSGSADSGKLAAPWHIPTIALPEGDIEDQPPPWQPENCWEEQTPGFKSHFLSTPRAGPPGRRLVPSERANSPNPGSPGESSACSPAASNIWEESSQAPGGPELLPEEPNQASPWASSSPARVTRREDLTHALVWEGGSDPLLELSAEDLRTLSPRGSLLDVATSPAGTSGRLELPAQLERTASKPPAVPPKTEKALRRAKKLASKRRKTDQAQEKHGESQEGKPCPEDLEQTQQRPLCPRERPRHNFPVVRSLPPPVHRHSVSGFSEPVGRRPGGPQSLTPLPTYTSTL

SEQ ID NO: 2865 - protein, 227 aa, Homo sapiens
MSDINLDWVDRRQLQRLEEMLIVVDENDKVIGADTKRNCHLNENIEKGLLHRAFSVVLFNTKNRILIQQRSDTKVTFPGYFTDSCSSHPLYNPAELEEKDAIGVRRAAQRRLQAELGIPGEQISPEDIVFMTIYHHKAKSDRIWGEHEICYLLLVRKNVTLNPDPSETKSILYLSQEELWELLEREARGEVKVTPWLRTIAERFLYRWWPHLDDVTPFVELHKIHRV

SEQ ID NO: 2866 - protein, 357 aa, Homo sapiens
MGGAVSAGEDNDDLIDNLKEAQYIRTERVEQAFRAIDRGDYYLEGYRDNAYKDLAWKHGNIHLSAPCIYSEVMEALKLQPGLSFLNLGSGTGYLSTMVGLILGPFGINHGIELHSDVVEYAKEKLESFIKNSDSFDKFEFCEPAFVVGNCLQIASDSHQYDRIYCGAGVQKDHENYMKILLKVGGILVMPIEDQLTQIMRTGQNTWESKNILAVSFAPLVQPSKNDNGKPDSVGLPPCAVRNLQDLARIYIRRTLRNFINDEMQAKGIPQRAPPKRKRKRVKQRINTYVFVGNQLIPQPLDSEEDEKMEEDIKEEEEKDHNEAMKPEEPPQNLLREKIMKLPLPESLKAYLTYFRDK

SEQ ID NO: 2867 - protein, 369 aa, Homo sapiens [sequence omitted]

SEQ ID NO: 2868 - protein, 304 aa, Homo sapiens
MLQKPRNRGRSGGQAERDRDWSHSGNPGASRAGEDARVLRDGFAEEAPSTSRGPGGSQGSQGPSPQGARRAQAAPAVGPRSQKQLELKVSELVQFLLIKDQKKIPIKRADILKHVIGDYKDIFPDLFKRAAERLQYVFGYKLVELEPKSNTYILINTLEPVEEDAEMRGDQGTPTTGLLMIVLGLIFMKGNTIKETEAWDFLRRLGVYPTKKHLIFGDPKKLITEDFVRQRYLEYRRIPHTDPVDYEFQWGPRTNLETSKMKVLKFVAKVHNQDPKDWPAQYCEALADEENRARPQPSGPAPSS

SEQ ID NO: 2869 - protein, 385 aa, Homo sapiens [sequence omitted]

SEQ ID NO: 2870 - protein, 232 aa, Homo sapiens [sequence omitted]

SEQ ID NO: 2871 - protein, 118 aa, Homo sapiens
MARCKNADGVELYNEIEFYAKVNSKDSQDKRSSRSITCFVRKWKEKVAWPRLTKEDIKPVWLSVDFDNWRDWEGDEEMELAHVEHYAELLKKVSTKRPPPAMDDLDDDSDSADDATSN

SEQ ID NO: 2872 - protein, 325 aa, Homo sapiens
MKSTNTTRNSSKKSWRRSPGLRIKGEAKISIHVLTSDMSHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNEYWVNTLSSSSLLTNADYTTGQVFDLSEKLEQSEAQLGRGSFMLGLETHDRKSEDKLAKATRDSCKTTIEAIHGLMSQVIKDKLFNQINIS

SEQ ID NO: 2873 - protein, 580 aa, Homo sapiens
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVADTPELLRSKAGAQLQSDVRYTEDYEQQRGKGSFPAMITPAYQIAKRANELASDVRYHQQYQKEMRGMAGPAIGAEGILTRECADQYGQGYPEEYEEHRGKGSFPAMITPAYQNAKKAHELASDIKYRQDFNKMKGTAHYHSLPAQDNLVLKRAQSVNKLVSEVEYKKDLESSRGHSINYCETPQFRNVSKISKFTSDNKYKENYQNHMRGRYEGVGMDRRTLHAMKVGSLASNVAYKADYKHDIVDYNYPATLTPSYQTAMKLVPLKDANYRQSIDKLKYSLVTDTPQIVQAKINAQQLSHVNYRADYEKNKLNYTLPQDVPQLVKAKTNAKLFSEAKYKEGWEKTKGKGFEMKLDAMSLLAAKASGELASN

SEQ ID NO: 2874 - protein, 100 aa, Homo sapiens
MAEKQLDYNLCRQHGHKDDHKGPKTEKRNTSSPLGAASPTLLSPLLCHPLMCQGIPFQASCKETVGSGKGELGIEGLRDLTLRRGCALIPCLLHYQCLKT

SEQ ID NO: 2875 - protein, 149 aa, Homo sapiens
MAHSHHRQWKLTVSGSPAGAVNHPSPCEHLASPDFLHMAGFLQSKHPERARQKLPSLTSPRASLWPRSTGQSSHNPPSFRKRGRSAQGLKRGVAKSHQRVACGVESSVAAIFGKHCHSHLPKTAGLGAPDGRDLQFGKPLFGVNSILIH

SEQ ID NO: 2876 - protein, 337 aa, Homo sapiens
MPDSNFAERSEEQVSGAKVIAQALKTQDVEYIFGIVGIPVTEIAIAAQQLGIKYIGMRNEQAVDICAEELGNNVKPAVTLLGNIHAVTKQLLEELDKTPWQYPPESKWWKTLREKMKSNEAASKELASKKSLPMNYYTVFYHVQEQLPRDCFVVSEGANTMDIGRTVLQNYLPRHRLDAGTFGTMGVGLGFAIAAAVVAKDRSPGQWIICVEGDSAFGFSGMEVETICRYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQDFHWLTRSNM

SEQ ID NO: 2877 - protein, 331 aa, Homo sapiens
MSMTTRAWEELDGGLGSCQALEDHSALAETQEDRASATPRLADSGSVPHDSQVAEGPSVDTRPKKMEKEPAARGTPGTGKERLKAGASPRSVPARKKAQTAPPLQPPPPPPALSEELPWGDLSLNKCLVLASLVALLGSAFQLCRDAVPGEAALQARVPEPWVPPSSAPREPSSPLPKFEAQAPPSAPPAPRAEAEVRPKIPGSREAAENDEEEPGEATGEAVREDRVTLADRGPKERPRREGKPRKEKPRKEERPKKERPRKEERPRAAREPREALPQRWESREGGHRPWARDSRDAEPRKKQAWVSPRRPDEEQRPGSRQKLRAGKGRD

SEQ ID NO: 2878 - protein, 113 aa, Homo sapiens
MQSVSTVLPLNSHMRTEPVTSFFGKRNHLKIRWFLGATSGLRLQKTKSGNWAICSPGRQCFPSSTPSVVIWNTWHFTWSLAICPWLEKLRHENRQVWVRNKGGRQFRSFHFMF

SEQ ID NO: 2879 - protein, 477 aa, Homo sapiens [sequence omitted]

SEQ ID NO: 2880 - protein, 411 aa, Homo sapiens
MTHWFHRNPLKATAPVSFNYYGVVTGPSASKICNDLRSSRARLLELFTDLSCNPEMMKNAADSYFSLLQGFINSLDESTQESKLRYIQNFKWTDTLQGQVPSAQQDAVFELISMGFNVALWYTKYASRLAGKENITEDEAKEVHRSLKIAAGIFKHLKESHLPKLITPAEKGRDLESRLIEAYVIQCQAEAQEVTIARAIELKHAPGLIAALAYETANFYQKADHTLSSLEPAYSAKWRKYLHLKMCFYTAYAYCYHGETLLASDKCGEAIRSLQEAEKLYAKAEALCKEYGETKGPGPTVKPSGHLFFRKLGNLVKNTLEKCQRENGFIYFQKTPTEAPQLELKANYGLVEPIPFEFPPTSVQWTPETLAAFDLTKRPKDDSTKPKPEEEVKPVKEPDIKPQKDTGCYIS

SEQ ID NO: 2881 - protein, 218 aa, Homo sapiens
MASRGGGRGRGRGQLTFNVEAVGIGKGDALPPPTLQPSPLFPPLEFRPVPLPSGEEGEYVLALKQELRGAMRQLPYFIRPAVPKRDVERYSDKYQMSGPIDNAIDWNPDWRRLPRELKIRVRKLQKERITILLPKRPPKTTEDKEETIQKLETLEKKEEEVTSEEDEEKEEEEEKEEEEEEEYDEEEHEEETDYIMSYFDNGEDFGGDSDDNMDEAIY

SEQ ID NO: 2882 - protein, 117 aa, Homo sapiens
MPSCSCALMAPCGPAAGPAAVERTQQVARGEPGSARGQLQVSPEMSITHKEKENAHLKEILLFVNAEAFSQPQPHSAPVCEGQQLTGKFSTSVLTRAGGDASPCSWERLLCYGWSHC

SEQ ID NO: 2883 - protein, 355 aa, Homo sapiens
MPFLGQDWRSPGQNWVKTADGWKRFLDEKSGSFVSDLSSYCNKEVYNKENLFNSLNYDVAAKKRKKDMLNSKTKTQYFHQEKWIYVHKGSTKERHGYCTLGEAFNRLDFSTAILDSRRFNYVVRLLELIAKSQLTSLSGIAQKNFMNILEKVVLKVLEDQQNIRLIRELLQTLYTSLCTLVQRVGKSVLVGNINMWVYRMETILHWQQQLNNIQITRPAFKGLTFTDLPLCLQLNIMQRLSDGRDLVSLGQAAPDLHVLSEDRLLWKKLCQYHFSERQIRKRLILSDKGQLDWKKMYFKLVRCYPRKEQYGDTLQLCKHCHILSWKGTDHPCTANNPESCSVSLSPQDFINLFKF

SEQ ID NO: 2884 - protein, 209 aa, Homo sapiens
MAKAPSWAGVGALAYKAPEALWPAEAVMDGTMEDSEAVQRATALIEQRLAQEEENEKLRGDTRQKLPMDLLVLEDEKHHGAQSAALQKVKGQERVRKTSLDLRREIIDVGGIQNLIELRKKRKQKKRDALAASHEPPPEPEEITGPVDEETFLKAAVEGKMKVIEKFLADGGSADTCDQFRRTALHRASLEGHMEILEKLLDNGATVDF

SEQ ID NO: 2885 - protein, 419 aa, Homo sapiens
MAVSNIRYGAAVTKEVGMDLKNMGAKNVCLMTDKNLSKLPPVQVAMDSLVKNGIPFTVYDNVRVEPTDSSFMEAIEFAQKGAFDAYVAVGGGSTMDTCKAANLYASSPHSDFLDYVSAPIGKGKPVSVPLKPLIAVPTTSGTGSETTGVAIFDYEHLKVKIGITSRAIKPTLGLIDPLHTLHMPARVVANSGFDVLCHALESYTTLPYHLRSPCPSNPITRPAYQGSNPISDIWAIHALRIVAKYLKRAVRNPDDLEARSHMHLASAFAGIGFGNAGVHLCHGMSYPISGLVKMYKAKDYNVDHPLVPHGLSVVLTSPAVFTFTAQMFPERHLEMAEILGADTRTARIQDAGLVLADTLRKFLFDLDVDDGLAAVGYSKADIPALVKGTLPQERVTKLAPRPQSEEDLAALFEASMKLY

SEQ ID NO: 2886 - protein, 237 aa, Homo sapiens
MPVKKKRKSPGVAAAVAEDGGLKKCKISSYCRSQPPARLISGEEHFSSKKCLAWFYEYAGPDEVVGPEGMEKFCEDIGVEPENIIMLVLAWKLEAESMGFFTKEEWLKGMTSLQCDCTEKLQNKFDFLRSQLNDISSFKNIYRYAFDFARDKDQRSLDIDTAKSMLALLLGRTWPLFSVFYQYLEQSKYRVMNKDQWYNVLEFSRTVHADLSNYDEDGAWPVLLDEFVEWQKVRQTS

SEQ ID NO: 2887 - protein, 119 aa, Homo sapiens
MGAEPDPGRDPAQDELRQPEGPREDGSESCLRLQKSPDTTSLVKARDPKLSQDHLTGLPPCHLAASLSQSACKLFLQPRVSFPAKGLCTCCSFCLEVHRRLSQGLHPSHCMVPISCRRL

SEQ ID NO: 2888 - protein, 247 aa, Homo sapiens [sequence omitted]

SEQ ID NO: 2889 - protein, 247 aa, Homo sapiens
MAWAGSRRVPAGTRAAAERCCRLSLSPGAQPAPPPGPPPPPRPMRFLTSCSLLLPRAAQILAAEAGLPSSRSFMGFAAPFTNKRKAYSERRIMGYSMQEMYEVVSNVQEYREFVPWCKKSLVVSSRKGHLKAQLEVGFPPVMERYTSAVSMVKPHMVKAVCTDGKLFNHLETIWRFSPGIPAYPRTCTVDFSISFEFRSLLRSQLATMFFDEAVKQNVAAFERRAATKFGPETAIPRELMFHEVHQT

SEQ ID NO: 2890 - protein, 264 aa, Homo sapiens
MFVPCGESAPDLAGFTLLMPAVSVGNVGQLAMDLIISTLNMSKIGYFYTDCLVPMVGNNPYATTEGNSTELSINAEVYSLPSRKLVALQLRSIFIKYKSKPFCEKLLSWVKSSGCARVIVLSSSHSYQRNDLQLRSTPFRYLLTPSMQKSVQNKIKSLNWEEMEKSRCIPEIDDSEFCIRIPGGGITKTLYDESCSKEIQMAVLLKFVSEGDNIPDALGLVEYLNEWLQILKPLSDDPTVSASRWKIPSSWRLLFGSGLPPALF

SEQ ID NO: 2891 - protein, 293 aa, Homo sapiens [sequence omitted]

SEQ ID NO: 2892 - protein, 163 aa, Homo sapiens
MGDECSNPDLLAEPGSSPPWDHGNQRQEAANESNTRVPRVLKAHLGPETAQPTKRSKRNRWRRQSCQGPSPARSGQFLGSADLGLQRGVLKSAARTCLSEISNSTRASPESAQSTDPGRAARPRTRTLPTPHSFKIGEEAEEMKKKKERKRRKERKKERNFKK

SEQ ID NO: 2893 - protein, 449 aa, Homo sapiens
MKGSNRNKDHSAEGEGVGKRPKRKCLQWHPLLAKKLLDFSEEEEEEDEEEDIDKVQLLGADGLEQDVGETEDDESPEQRARRPMNAFLLFCKRHRSLVRQEHPRLDNRGATKILADWWAVLDPKEKQKYTDMAKEYKDAFMKANPGYKWCPTTNKPVKSPTPTVNPRKKLWAFPSDSSRDLPSPKKAKTEEMPQLNFGMADPTQMGGLSMLLLAGEHALGTPEVSSGTCRPDVSESPELRQKSPLFQFAEISSSTSHSDASTKQCQTSALFQFAEISSNTSQLGGAEPVKRCGKSALFQLAEMCLASEGMKMEESKLIKAKESDGGRIKELEKGKEEKEIKMEKTDETRLQKEAEFEKSAKENLRDSKELRNFEALQIDDIMAIKMEDPKEIRKEELEEDHKCSHFPDFSYSASSKIIISDVPSRKDHMCHPHGIMIIEDPAALNKPEK

SEQ ID NO: 2894 - protein, 258 aa, Homo sapiens
MDFISIQQLVSGERVEGKVLGFGHGVPDPGAWPSDWRRGPQEAVAREKLKLEEEKKKKLERFNSTRFNLDNLADLENLVQRRKKRLRHRVPPRKPEPLVKPQSQAQVEPVGLEMFLKAAAENQEYLIDKYLTDGGDPNAHDKLHRTALHWACLKGHSQLVNKLLVAGATVDARDLLDRTPVFWACRGGHLVILKQLLNQGARVNARDKIGSTPLHVAVRTRHPDCLEHLIECGAHLNAPSVRFKLHWCRPVLLVGLGP

SEQ ID NO: 2895 - protein, 364 aa, Homo sapiens
MTEKEVLESPKPSFPAETRQSGLQRLKQLLRKGSTGTKEMELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPPGFHRAYSSPLYSNQQYACVKDLSAANRNDPVFETLRTGVIMANKERKKGQADKKNPVAAMMEEEPESARPEEGKPQDGNPEGDKKAEKKTPDDKHKQPGFQQSHYFVALYRFKALEKDDLDFPPGEKITVIDDSNEEWWRGKIGEKVGFFPPNFIIRVRAGERVHRVTRSFVGNREIGQITLKKDQIVVQKGDEAGGYVKVYTGRKVGLFPTDFLEEI

SEQ ID NO: 2896 - protein, 230 aa, Homo sapiens
MHSSSPSPTNDRGLRRTIRLAPLSFGLRFLTSCSLLLPRAAQILAAEAGLPSSRSFMGFAAPFTNKRKAYSERRIMGYSMQEMYEVVSNVQEYREFVPWCKKSLVVSSRKGHLKAQLEVGFPPVMERYTSAVSMVKPHMVKAVCTDGKLFNHLETIWRFSPGIPAYPRTCTVDFSISFEFRSLLHSQLATMFFDEVVKQNVAAFERRAATKFGPETAIPRELMFHEVHQT

SEQ ID NO: 2897 - protein, 109 aa, Homo sapiens
MKEGIPAGFLLWGWQVAWYYAQGRSAWGKGQPGRGPVSGRLLNFLEGVIGWKEARNPSLRDCCAPHSLTAQSRLCWQEALRLPFLCIEKQCLPIYFAFNSKRSSGKTCG

SEQ ID NO: 2898 - protein, 132 aa, Homo sapiens [sequence omitted]

SEQ ID NO: 2899 - protein, 119 aa, Homo sapiens [sequence omitted]

SEQ ID NO: 2900 - protein, 133 aa, Homo sapiens
MYSASGELAAPRPPRSSQHNCLEGRLREGEADGMSSKGDRCCAAHTTPEPDKAPAGPLARSMSVQQCFCPCTFQKPSWEGMQPGRLLPDGAGSLFKENSVSHRPRLSFRLAWALLAQCVLLAQQKHPFELASL

SEQ ID NO: 2901 - protein, 171 aa, Homo sapiens [sequence omitted]

SEQ ID NO: 2902 - protein, 423 aa, Homo sapiens
MPQATSPPLWPLSLHGGKGILWARHSHPPGPPSHHIQDSGRCSLPLPQSPGVTPLPARLSGATPLSPIRLLSSFVPRGPRVIPLTNQARRTLHASLGGCWGRTTDAADTASLKAWQGGTLGRHLQGPHLTSPQPQEADPSSWSPSRVGGMVASVSWALGPPHCEEEVWALWEVSSRGHADLGSESWCPLLLPSHFSSESWCPLLLPSHFSTGGPEFLKTPLGGSFLVYESFLYRREKAAGEKVYWTCRDQARMGCRSRAITQGRRVMVMRRHCHPPDLGGLEALRQREHFPNLAQWDSPDPLRPLEFLRTSLGGRFLVHESFLYRKEKAAGEKVYWMCRDQARLGCRSRAITQGHRIMVMRSHCHQPDLAGLEALRQRERLPTTAQQEDPEKIQVQLCFKTCSPESQQIYGDIKDVRLDGESQ

SEQ ID NO: 2903 - protein, 246 aa, Homo sapiens [sequence omitted]

SEQ ID NO: 2904 - protein, 224 aa, Homo sapiens
MVCLVLLNHPKELNMAKQMVKASRLFYFGSARSPLTCDLCCPSRWSQAIQPCPLPLCPDASGARLFRLALTSGRQPTLRDVANTTPPVLSVGRAEAAWEARGDRKRALSSSEKRICHQIEFRPLSLFGRMVQIQIKVVTQPEMSGKAFCRENVPPPAICSQVCATRQPSRNIVWILKMCLFLFLNHFITYFLIYFVMSCFEVLLLSLLSFPLFLSLIYFVKVVH

SEQ ID NO: 2905 - protein, 766 aa, Homo sapiens
MVTVGNYCEAEGPVGPAWMQDGLSPCFFFTLVPSTRMALGTLALVLALPCRRRERPAGADSLSWGAGPRISPYVLQLLLASVLESLAGACGLWLLVVERSQARQRLAMGIWIKFRHSPGLLLLWTVAFAAENLALVSWNSPQWWWARADLGQQVRSAAQQSTWRDFGRKLRLLSGYLWPRGSPALQLVVLICLGLMGLERALNVLVPIFYRNIVNLLTEKAPWNSLAWTVTSYVFLKFLQGGGTGSTGFVSNLRTFLWIRVQQFTSRRVELLIFSHLHELSLRWHLGRRTGEVLRIADRGTSSVTGLLSYLVFNVIPTLADIIIGIIYFSMFFNAWFGLIVFLCMSLYLTLTIVVTEWRTKFRRAMNTQENATRARAVDSLLNFETVKYYNAESYEVERYREAIIKYQGLEWKSSASLVLLNQTQNLVIGLGLLAGSLLCAYFVTEQKLQVGDYVLFGTYIIQLYMPLNWFGTYYRMIQTNFIDMENMFDLLKEETEVKDLPGAGPLRFQKGRIEFENVHFSYADGRETLQDVSFTVMPGQTLALVGPSGAGKSTILRLLFRFYDISSGCIRIDGQDISQVTQASLRSHIGVVPQDTVLFNDTIADNIRYGRVTAGNDEVEAAAQAAGIHDAIMAFPEGYRTQVGERGLKLSGGEKQRVAIARTILKAPGIILLDEATSALDTSNERAIQASLAKVCANRTTIVVAHRLSTVVNADQILVIKDGCIVERGRHEALLSRGGVYADMWQLQQGQEETSEDTKPQTMER

SEQ ID NO: 2906 - protein, 216 aa, Homo sapiens
MSTVDLARVGACILKHAVTGEAVELRSLWREHACVVAGLRRFGCVVCRWIAQDLSSLAGLLDQHGVRLVGVGPEALGLQEFLDGDYFAGELYLDESKQLYKELGFKRLWTQASPEFGQATWCLRRYNSLSILPAALGKPVRDVAAKAKAVGIQGNLSGDLLQSGGLLVVSKGGDKVLLHFVQKSPGDYVPKEHILQVLGISAEVCASDPPQCDREV

SEQ ID NO: 2907 - protein, 567 aa, Homo sapiens
MSSRLGAVPATSGPTTFKQQRSTSIVGAKNSRTQCSIKDNSFQYTIPHDDSLSGSSSASSCEPVSDFPASFRKSTYWMKMRRIKPAATSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHKRGRK

SEQ ID NO: 2908 - protein, 562 aa, Homo sapiens
MSENLDNEGPKPMESCGQESSSALSCPTVSVPPAAPAALEEVEKEGAGAATGPGPQPGLYSYIRDDLFTSEIFKLELQNVPRHASFSDVRRFLGRFGLQPHKTKLFGQPPCAFVTFRSAAERDKALRVLHGALWKGRPLSVRLARPKADPMARRRRQEGESEPPVTRVADVVTPLWTVPYAEQLERKQLECEQVLQKLAKEIGSTNRALLPWLLEQRHKHNKACCPLEGVRPSPQQTEYRNKCEFLVGVGVDGEDNTVGCRLGKYKGGTCAVAAPFDTVHIPEATKQVVKAFQEFIRSTPYSAYDPETYTGHWKQLTVRTSRRHQAMAIAYFHPQKLSPEELAELKTSLAQHFTAGPGRASGVTCLYFVEEGQRKTPSQEGLPLEHVAGDRCIHEDLLGLTFRISPHAFFQVNTPAAEVLYTVIQDWAQLDAGSMVLDVCCGTGTIGLALARKVKRVIGVELCPEAVEDARVNAQDNELSNVEFHCGRAEDLVPTLVGRLASQHLVAILDPPRAGLHSKVILAIRRAKNLRRLLYVSCNPRAAMGNFVDAPLFPPQPLQSPI

SEQ ID NO: 2909 - protein, 380 aa, Homo sapiens
MPPGEGVQGPDPGTEEQLSQDPGDETRAFQEQALPVLQAGPGLPAVNPRDQEMAAGFFTAGSQGLGPFKDMALAFPEEEWRHVTPAQIDCFGEYVEPQDCRVSPGGGSKEKEAKPPQEDLKGALVALTSERFGEASLQGPGLGRVCEQEPGGPAGSAPGLPPPQHGAIPLPDEVKTHSSFWKPFQCPECGKGFSRSSNLVRHQRTHEEKSYGCVECGKGFTLREYLMKHQRTHLGKRPYVCSECWKTFSQRHHLEVHQRSHTGEKPYKCGDCWKSFSRRQHLQVHRRTHTGEKPYTCECGKSFSRNANLAVHRRAHTGEKPYGCQVCGKRFSKGERLVRHQRIHTGEKPYHCPACGRSFNQRSILNRHQKTQHRQEPLVQ

SEQ ID NO: 2910 - protein, 338 aa, Homo sapiens
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLCQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGT

SEQ ID NO: 2911 - protein, 246 aa, Homo sapiens [sequence omitted]

SEQ ID NO: 2912 - protein, 193 aa, Homo sapiens
MEPLASNIQVLLQAAEFLERREREAEHGYASLCPHRSPGPIHRRKKRPPQAPGAQDSGRSVHNELEKRRRAQLKRCLERLKQQMPLGADCARYTTLSLLRRARMHIQKLEDQEQRARQLKERLRSKQQSLQRQLEQLRGLAGAAERERLRADSLDSSGLSSERSDSDQVLPNENGGTPNHRPTGRGNNISSHH

SEQ ID NO: 2913 - protein, 299 aa, Homo sapiens
MHPGCWVQEALVLNHEGDMGFSEPGSHICRALGGLSPKCTCSGPLRRPGLPSAGRSWFSSGVRLPPSSPGSGPFSSPGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 2914 - protein, 137 aa, Homo sapiens
MPSGEGKQSVLIPTPVAGVCKPPLSSAGGSLDVCAHQGDLPAPELCPQVHLCLPKSARRDHFPCNAPQPNTRRVWHLGRNSWGGAVERVEVSGKTPTAAAPTVRAPAAQARASRSALEAAARTFPGAVSCQPAITQS

SEQ ID NO: 2915 - protein, 668 aa, Homo sapiens
MASSGEDISNDDDDMHPAAAGMADGVHLLGFSDEILLHILSHVPSTDLILNVRRTCRKLAALCLDKSLIHTVLLQKDYQASEDKVRQLVKEIGREIQQLSMAGCYWLPGSTVEHVARCRSLVKVNLSGCHLTSLRLSKMLSALQHLRSLAIDVSPGFDASQLSSECKATLSRVRELKQTLFTPSYGVVPCCTSLEKLLLYFEILDRTREGAILSGQLMVGQSNVPHYQNLRVFYARLAPGYINQEVVRLYLAVLSDRTPQNLHAFLISVPGSFAESGATKNLLDSMARNVVLDALQLPKSWLNGSSLLQHMKFNNPFYFSFSRCTLSGGHLIQQVINGGKDLRSLASLNLSGCVHCLSPDSLLRKAEDDIDSSILETLVASCCNLRHLNLSAAHHHSSEGLGRHLCQLLARLRHLRSLSLPVCSVADSAPRADRAPAQPAMHAVPRGFGKKVRVGVQSCPSPFSGQACPQPSSVFWSLLKNLPFLEHLELIGSNFSSAMPRNEPAIRNSLPPCSRAQSVGDSEVAAIGQLAFLRHLTLAQLPSVLTGSGLVNIGLQCQQLRSLSLANLGMMGKVVYMPALSDMLKHCKRLRDLRLEQPYFSANAQFFQALSQCPSLQRLCLVSRSGTLQPDAVLAFMARCLQVVMCHLFTGESLATCKSLQQSLLRSR

SEQ ID NO: 2916 - protein, 285 aa, Homo sapiens
MGLGVSAEQPAGGAEGFHLHGDVEPSSPAALAGLRPYTDYVVGSDQILQEPPSYHKKPPGTPPPSALPLGAPPPDALPPGPTPEDSPSLETGSRQSDYMEALLQAPGSSMEDPLPGPGSPSHSAPDPDGLPHFMETPLQPPPPVQRVMDPGFLDVSGISLLDNSNASVWPSLPSSTELTTTAVSTSGPEDICSSSSSHERGGEATWSGSEFEVSFLDSPGAQAQADHLPQLTLPDSLTSAASPEDGLSAELLEAQAEEEPASTEGLDTGTEAEGLDSQAQISTTE

SEQ ID NO: 2917 - protein, 186 aa, Homo sapiens [sequence omitted]

SEQ ID NO: 2918 - protein, 190 aa, Homo sapiens
MWPPRCKDPGRQSAEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 2919 - protein, 1093 aa, Homo sapiens
MSSCRRSWRRQRSAALSWLRRQTRRAAASPSSAVCWPSWQTSTSRSSTDANPEVTMTMLRWIYTDELEFREDDVFLTELMKLANRFQLQLLRERCEKGVMSLVNVRNCIRFYQTAEELNASTLMNYCAEIIASHWDDLRKEDFSSMSAQLLYKMIKSKTEYPLHKAIKVEREDVVFLYLIEMDSQLPGKLNEADHNGDLALDLALSRRLESIATTLVSHKADVDMVDKSGWSLLHKGIQRGDLFAATFLIKNGAFVNAATLGAQETPLHLVALYSSKKHSADVMSEMAQIAEALLQAGANPNMQDSKGRTPLHVSIMAGNEYVFSQLLQCKQLDLELKDHEGSTALWLAVQHITVSSDQSVNPFEDVPVVNGTSFDENSFAARLIQRGSHTDAPDTATGNCLLQRAAGAGNEAAALFLATNGAHVNHRNKWGETPLHTACRHGLANLTAELLQQGANPNLQTEEALPLPKEAASLTSLADSVHLQTPLHMAIAYNHPDVVSVILEQKANALHATNNLQIIPDFSLKDSRDQTVLGLALWTGMHTIAAQLLGSGAAINDTMSDGQTLLHMAIQRQDSKSALFLLEHQADINVSRTQDGETALQLAIRNQLPLVVDAICTRGADMSVPDEKGNPPLWLALANNLEDIASTLVRHGCDATCWGPGPGGCLQTLLHRAIDENNEPTACFLIRSGCDVNSPRQPGANGEGEEEARDGQTPLHLAASWGLEETVQCLLEFGANVNAQDAEGRTPIHVAISSQHGVIIQLLVSHPDIHLNVRDRQGLTPFACAMTFKNNKSAEAILKRESGAAEQVDNKGRNFLHVAVQNSDIESVLFLISVHANVNSRVQDASKLTPLHLAVQAGSEIIVRNLLLAGAKVNELTKHRQTALHLAAQQDLPTICSVLLENGVDFAAVDENGNNALHLAVMHGRLNNIRVLLTECTVDAEAFNLRGQSPLHILGQYGKENAAAIFDLFLECMPGYPLDKPDADGSTVLLLAYMKGNANLCRAIVRSGARLGVNNNQGVNIFNYQVATKQLLFRLLDMLSKEPPWCDGSYCYECTARFGVTTRKHHCRHCGRLLCHKCSTKEIPIIKFDLNK

SEQ ID NO: 2920 - protein, 154 aa, Homo sapiens
MLPKLAIMSAGSGGWALGSSLLSCKMGITEAVPGTMRSRCSRKVVSAEGKSQSQKVAYSHSVYLFLFLRQGLALSPRLEYSGAIWAHCNLHLLGSSDPPISDPQGAGATGTCHRVRLIFVFFVETGFHHVAQAGLKLPSSGDPPALACDKIAQK

SEQ ID NO: 2921 - protein, 365 aa, Homo sapiens
MELVQHIGIPASKIICANPCKQIAQIKYAAKHGIQLLSFDNEMELAKVVKSHPSAKMVLCIATDDSHSLSCLSLKFGVSLKSCRHLLENAKKHHVEVVGVSFHIGSGCPDPQAYAQSIADARLVFEMGTELGHKMHVLDLGGGFPGTEGAKVRFEEIASVINSALDLYFPEGCGVDIFAELGRYYVTSAFTVAVSIIAKKEVLLDQPGREEENGSTSKTIVYHLDEGVYGIFNSVLFDNICPTPILQKKPSTEQPLYSSSLWGPAVDGCDCVAEGLWLPQLHVGDWLVFDNMGAYTVGMGSPFWGTQACHITYAMSRVAWEALRRQLMAAEQEDDVEGVCKPLSCGWEITDTLCVGPVFTPASIM

SEQ ID NO: 2922 - protein, 401 aa, Homo sapiens [sequence omitted]

SEQ ID NO: 2923 - protein, 160 aa, Homo sapiens
MGPSVLRPLRRAEHPDVARSPKGVGSPLQGPACCLFPAGGVHNGVSKDRFPPLAPLSLSPPSSSAFQPHKGPVRFGTATAQGSEAKSPWVGVFQDTWPCVSCLLSPQPLGSWERDSHGSRARDPWAEPQKWLSILAWAGVGVEARGPAQADEAPSFQGGN

SEQ ID NO: 2924 - protein, 104 aa, Homo sapiens
MSSLLLPSQSCDPVMSTRMALWSLEHPSCCRVLQPHPFSTGPWYPGSSLSSATDLCALVYFSARGTHPKTISSSFPGDVVPQGWALPAVAQLLSAAQETPGCSE

SEQ ID NO: 2925 - protein, 169 aa, Homo sapiens
MCVKLLPLGATDTAVFDVRLSGKTKTVPGYLRIGDMGGFAIWCKKAKAPRPVPKPRGLSRDMQGLSLDAASQPSKGGLLERTASRLGSRASTLRRNDSIYEASSLYGISAMDGVPFTLHPRFEGKSCSPLAFSAFGDLTIKSLADIEEEYNYGFVVEKTAAARLPPSVS

SEQ ID NO: 2926 - protein, 157 aa, Homo sapiens
MPRRGLVAGPDLEYFQRRYFTPAEVAQHNRPEDLWVSYLGRVYDLTSLAQEYKGNLLLKPIVEVAGQDISHWFDPKTRDIRKHIDPLTGCLRYCTPRGRFVHVPPQLPCSDWANDFGKPWWQGSYYEVGRLSAKTRSIRIINTLTSQEHTLELHVEI

SEQ ID NO: 2927 - protein, 523 aa, Homo sapiens
MVGQRVLLLVAFLLSGVLLSEAAKILTISTLGGSHYLLLDRVSQILQEHGHNVTMLHQSGKFLIPDIKEEEKSYQVIRWFSPEDHQKRIKKHFDSYIETALDGRKESEALVKLMEIFGTQCSYLLSRKDIMDSLKNENCDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQDLDNFIANFGDAGFVLVAFGSMLNTHQSQEVLKKMHNAFAHLPQGVIWTCQSSHWPRDVHLATNVKIVDWLPQSDLLAHPSIRLFVTHGGQNSVMETIRHGVPMVGLPVNGDQHGNMVRVVAKNYGVSIRLNQVTADTLTLTMKQVIEDKRYKSAVVAASVILHSQPLSPAQRLVGWIDHILQTGGATHLKPYVFQQPWHEQYLIDVFVFLLGLTLGTMWLCGKLLGVVARWLRGARKVKKT

SEQ ID NO: 2928 - protein, 101 aa, Homo sapiens [sequence omitted]

SEQ ID NO: 2929 - protein, 856 aa, Homo sapiens
MSKRRMSVGQQTWALLCKNCLKKWRMKRQTLLEWLFSFLLVLFLYLFFSNLHQVHDTPQMSSMDLGRVDSFNDTNYVIAFAPESKTTQEIMNKVASAPFLKGRTIMGWPDEKSMDELDLNYSIDAVRVIFTDTFSYHLKFSWGHRIPMMKEHRDHSAHCQAVNEKMKCEGSEFWEKGFVAFQAAINAAIIEIATNHSVMEQLMSVTGVHMKILPFVAQGGVATDFFIFFCIISFSTFIYYVSVNVTQERQYITSLMTMMGLRESAFWLSWGLMYAGFILIMATLMALIVKSAQIVVLTGFVMVFTLFLLYGLSLITLAFLMSVLIKKPFLTGLVVFLLIVFWGILGFPALYTHLPAFLEWTLCLLSPFAFTVGMAQLIHLDYDVNSNAHLDSSQNPYLIIATLFMLVFDTLLYLVLTLYFDKILPAEYGHRCSPLFFLKSCFWFQHGRANHVVLENETDSDPTPNDCFEPVSPEFCGKEAIRIKNLKKEYAGKCERVEALKGVVFDIYEGQITALLGHSGAGKTTLLNILSGLSVPTSGSVTVYNHTLSRMADIENISKFTGFCPQSNVQFGFLTVKENLRLFAKIKGILPHEVEKEVQRVVQELEMENIQDILAQNLSGGQNRKLTFGIAILGDPQVLLLDEPTAGLDPLSRHRIWNLLKEGKSDRVILFSTQFIDEADILADRKVFISNGKLKCAGSSLFLKKKWGIGYHLSLHLNERCDPESITSLVKQHISDAKLTAQSEEKLVYILPLERTNKFPELYRDLDRCSNQGIEDYGVSITTLNEVFLKLEGKSTIDESDIGIWGQLQTDGAKDIGSLVELEQVLSSFHETRKTISGVALWRQQVCAIAKVRFLK

SEQ ID NO: 2930 - protein, 179 aa, Homo sapiens
MSSQKGNVARSRPQKHQNTFSFKNDKFDKSVQTKKINAKLHDGVCQRCKEVLEWRVKYSKYKPLSKPKKCVKCLQKTVKDSYHIMCRPCACELEVCAKCGKKEDIVIPWSLPLLPRLECSGRILAHHNLRLPCSSDSPASASRVAGTTGAHHHAQLIFVFLVEMGFHYVGQAGLELLTS

SEQ ID NO: 2931 - protein, 491 aa, Homo sapiens [sequence omitted]

SEQ ID NO: 2932 - protein, 101 aa, Homo sapiens
MLKEPQPSWFSGTIPVSVLNVLCPRKPYSLCKLGHWSHSGTQLRVRRAQLTSFSPDTGPTPTFHSGSWPGSSKPGIILGAGLSLVLENVDFSHTHTYTCTS

SEQ ID NO: 2933 - protein, 147 aa, Homo sapiens
MLVAAAAERNKDPILHVLRQYLDPAQRGVRVLEVASGSGQHAAHFARAFPLAEWQPSDVDQRCLDRCGPRGGHFYRCGGPGPQEPTARSPGGKGCGSGSEGAGWEPGGAPGAGPSCAAPAAAEVGGPRGPPSQPLWSPLLNVPPSLP

SEQ ID NO: 2934 - protein, 603 aa, Homo sapiens
MAIEQSLADKTRGPTTAEATASACTNRQPAHFYPWTRSTAPPESSPARAPMGLFQGVMQKYSSSLFKTSQLAPADPLIKAIKDGDEEALKTMIKEGKNLAEPNKEGWLPLHEAAYYGQVGCLKVLQRAYPGTIDQRTLQEETAVYLATCRGHLDCLLSLLQAGAEPDISNKSRETPLYKACERKNAEAVKILVQHNADTNHRCNRGWTALHESVSRNDLEVMQILVSGGAKVESKNAYGITPLFVAAQSGQLEALRFLAKYGADINTQASDNASALYEACKNEHEEVVEFLLSQGADANKTNKDGLLPLHIASKKGNYRIVQMLLPVTSRTRIRRSGVSPLHLAAERNHDEVLEALLSARFDVNTPLAPERARLYEDRRSSALYFAVVNNNVYATELLLQHGADPNRDVISPLLVAIRHGCLRTMQLLLDHGANIDAYIATHPTAFPATIMFAMKCLSLLKFLMDLGCDGEPCFSCLYGNGPHPPAPQPSSRFNDAPAADKEPSVVQFCEFVSAPEVSRWAGPIIDVLLDYVGNVQLCSRLKEHIDSFEDWAVIKEKAEPPRPLAHLCRLRVRKAIGKYRIKLLDTLPLPGRLIRYLKYENTQ

SEQ ID NO: 2935 - protein, 103 aa, Homo sapiens [sequence omitted]

SEQ ID NO: 2936 - protein, 137 aa, Homo sapiens [sequence omitted]

SEQ ID NO: 2937 - protein, 101 aa, Homo sapiens
MGSIPRSRHQHRGAQESGTIRRECSGRERGSPDSEPHAELGLDPSLLPGEGLLSPWLLCFPCPAQTELTQVRKAPAASSGPQPNRRMFSFLASVPRASWGQ

SEQ ID NO: 2938 - protein, 235 aa, Homo sapiens
MEYEVKKGKKGFVSPIRRLVFPKAGRRAACRSSVSRRPLHSMPLYPPDYLIDPQILLCDYLEKEVKFLGHLTWVTSSLNPSSRDELLQLLDTARQLKELPLKTTAEQDSILSLSARCLLLTWRDNEELILRIPTHEIAAASYLQDDALHLLVLKTGLGVDPVPAGVDASPGGAGRDPGPPGGAPEKRRVGTAERRHTICSLDWRMGWGGGAAEAPTRSTRRTPAPTPTATWSSWL

SEQ ID NO: 2939 - protein, 130 aa, Homo sapiens
MMMSGASGKVRAGKPGPWRTLPRGGPAYSQDPTLQAEQRAGEAQRARSSSWLPWEGSRETGRSSHCPRGHAWLSAHSIRRKGRGEVTCSTVKLISVTHAQQEGRALLHTLAALAAPEQSAAPASAMGPRG

SEQ ID NO: 2940 - protein, 122 aa, Homo sapiens
MPQLPHPYVGVMLARPPGRSGSKAAAVSCQVFTADETWSLNTAVPVLITRVSVMPPFPEGSPCSLRVPPSAMAARAASGSSLRPSFPFLESSTLAWPCRTKHNSEIPPQPSAVKLLRIRLFS

SEQ ID NO: 2941 - protein, 315 aa, Homo sapiens
MVDLSVSPDSLKPVSLTSSLVFLMHLLLLQPGEPSSEVKVLGPEYPILALVGEEVEFPCHLWPQLDAQQMEIRWFRSQTFNVVHLYQEQQELPGRQMPAFRNRTKLVKDDIAYGSVVLQLHSIIPSDKGTYGCRFHSDNFSGEALWELEVAGLGSDPHLSLEGFKEGGIQLRLRSSGWYPKPKVQWRDHQGQCLPPEFEAIVWDAQDLFSLETSVVVRAGALSNVSVSIQNLLLSQKKELVVQIADVFVPGASAWKSAFVATLPLLLVLAALALGVLRKQRRSREKLRKQAEKRQGERGQGVLHAPAQVPKPAVI

SEQ ID NO: 2942 - protein, 948 aa, Homo sapiens
MRWPQPGAAARLPPESPGPPESPGPPEREAAAARRWTGAEPQDCAPGSGRPEKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQQQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPSVDDPLEYQAGLLVQNAIQQAIAEQVDKAVSKTSRDGAEQQGPEATVEEAEAAAFGSEKPQSMFEPPQVSSPVQEKRDVLPKILPAEDRAPRERGPPQPLPAVQPSGPINMEETRPEGSYFSKYSEAAELRSTASLLATQESDVMVGPFKLRSRKQRTSSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 2943 - protein, 163 aa, Homo sapiens [sequence omitted]

SEQ ID NO: 2944 - protein, 128 aa, Homo sapiens
MRVHISSCLKVQEQMANCPKFVPVVPTSQPIPSNIPNRSTFACPYCGARNLDQQELVKHCVESHRSDPNRVVCPICSAMPWGDPSYKSANFLQHLLHRHKFSYDTFVDYSIDEEAAFQAALALSLSEN

SEQ ID NO: 2945 - protein, 109 aa, Homo sapiens [sequence omitted]

SEQ ID NO: 2946 - protein, 445 aa, Homo sapiens
MGESIPLAAPVPVEQAVLETFFSHLGIFSYDKAKDNVEKEREANKSAGGSWLSLLAALAHLAAAEKVYHSLTYLGQKLGGQSFFSRKDSIRTIYTSLHNELKKVVTGRGALGGTAPHVEELLSHLSEQLCFFVQARMEIADFYEKMYTLSTQKFINAEELVGLLDAIMKKYSSRFHHPILSPLESSFQLEVDVLCHLLKAQAQVSEWKFLPSLVNLHSAHTKLQTWGQIFEKQRETKKHLFGGQSQKAVQPPHLFLWLMKLKNMLLAKFSFYFHEALSRQTTASEMKTLTAKANPDFFGKISSFIRKYDAANVSLIFDNRGSESFQGHGYHHPHSYREAPKGVDQYPAVVSLPSDRPVMHWPNVIMIMTDRTSDLNSLEKVVHFYDDKVQSTYFLTRPEPHFTIVIIFESKKSERDSHFISFLNEVSLALKNPKVFASLKPGSKG

SEQ ID NO: 2947 - protein, 201 aa, Homo sapiens [sequence omitted]

SEQ ID NO: 2948 - protein, 176 aa, Homo sapiens
MHFLCKLVGRSIRRSTQMLQSTSQSFLRSARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 2949 - protein, 102 aa, Homo sapiens [sequence omitted]

SEQ ID NO: 2950 - protein, 176 aa, Homo sapiens [sequence omitted]

SEQ ID NO: 2951 - protein, 344 aa, Homo sapiens
MSLVPGLTSIEQPQPQLLDQLGIPRRCFQDWVDQNGLPGLSVTQQIRGITLLRRLECSNTIIAHCRHELLGPPTLSPSAWSSPASPPPRALPLGSCASKMLERGAESAAGATDPSPTGKEPVTKEAPHQGPPQKPSQSAPGPTASAGSPPRPRRRPPPQRPHRCPDCDKAFSYPSKLATHRLAHGGARPHPCPDCPKAFSYPSKLAAHRLTHSGARPHPCPHCPKSFGHRSKLAAHLWTHAPTRPYPCPDCPKSFCYPSKLAAHRHTHHATDARPYPCPHCPKAFSFPSKLAAHRLCHDPPTAPGSQATAWHRCSSCGQAFGQRRLLLLHQRSHHQVEHKGERD

SEQ ID NO: 2952 - protein, 361 aa, Homo sapiens
MAQRCVCVLALVAMLLLVFPTVSRSMGPRSGEHQRASRIPSQFSKEERVAMKEALKGAIQIPTVTFSSEKSNTTALAEFGKYIHKVFPTVVSTSFIQHEVVEEYSHLFTIQGSDPSLQPYLLMAHFDVVPAPEEGWEVPPFSGLERDGVIYGWGTLDDKNSVMALLQALELLLIRKYIPRRSFFISLGHDEESSGTGAQRISALLQSRGVQLAFIVDEGGFILDDFIPNFKKPIALIAVSEKGSMNLMLQVNMTSGHSSAPPKETSIGILAAAVSRLEQTPMPIIFGSGTVVTVLQQLANEVYGEKSLNQCNNQDHHGTHHIQSRGQVQCHPPSGPGHSQLPDSPWTDSPRGPRTHEEHCG

SEQ ID NO: 2953 - protein, 298 aa, Homo sapiens [sequence omitted]

SEQ ID NO: 2954 - protein, 176 aa, Homo sapiens [sequence omitted]

SEQ ID NO: 2955 - protein, 139 aa, Homo sapiens
MWHTVPRAGLGRVGCRGLPGCRAHPPGAWACCTEQAWALAPLTVPSRPSLCSGPRTGSGQQAPGLQDVLSLWSVCDDEHSWSFLYAGPWASERATGWRLSHEVEGQSQGLQATSCRHHALLPWAVLGAPSWPWAQWPVA

SEQ ID NO: 2956 - protein, 559 aa, Homo sapiens
MFAISSSGLSSARVQHCICSVASDHSVGLLSLREKKCIMLASRHLFPIQVIKWRPSDDYLVVGCSDGSVYVWQMDTGALDRCVMGITAVEILNACDEAVPAAVDSLSHPAVNLKQAMTRRSLAALKNMAHHKLQTLATNLLASEASDKGNLPKYSHNSLMVQAIKTNLTDPDIHVLFFDVEALIIQLLTEEASRPNTALISPENLQKASGSSDKGGSFLTGKRAAVLFQQVKETIKENIKEHLLDDEEEDEEIMRQRREESDPEYRSSKSKPLTLLEYNLTMDTAKLFMSCLHAWGLNEVLDEVCLDRLGMLKPHCTVSFGLLSRGGHMSLMLPGYNQPACKLSHGKTEVGRKLPASEGVGKGTYGVSRAVTTQHLLSIISLANTLMSMTNATFIGDHMKKGPTRPPRPSTPDLSKARGSPPTSSNIVQGQIKQGWSQLAAMHCVMLPDLLGLDKFRPPLLEMLARRWQDRCLEVREAAQALLLAELRRIEQAGRKEAIDAWAPYLPQYIDHVISPGVTSEAAQTITTAPDASGPEAKVQEEEHDLVDDDITTGCLSSV

SEQ ID NO: 2957 - protein, 123 aa, Homo sapiens
MDTFTVQDSTAMSWWRNNFWIILAVAIIVVSVGLGLILYCVCKKWEIAKPLKHKQVDEEKMYENVLNESPVQLPPLPPRNWPSLEDSYGVLLCHPGWSAMARSRLTASSASRVHAILLPQPPE

SEQ ID NO: 2958 - protein, 106 aa, Homo sapiens
MWRGTLGPGHCRLVPPEPLTGWGSCSFPGPHLGEVQCNSLALLSGLWRLHPGKWVLGLLYPILFCLTRSLVSLWSLKSVVHSVLVLVPSIPSFPHSCSSVSGWLLL

SEQ ID NO: 2959 - protein, 464 aa, Homo sapiens
MPQGPQLLDFSVDEVAEQLTLIDLELFSKVRLYECLGSVWSQRDRPGAAGASPTVRATVAQFNTVTGCVLGSVLGAPGLAAPQRAQRLEKWIRIAQRCRELRNFSSLRAILSALQSNPIYRLKRSWGAVSREPLSTFRKLSQIFSDENNHLSSREILFQEEATEGSQEEDNTPGSLPSKPPPGPVPYLGTFLTDLVMLDTALPDMLEGDLINFEKRRKEWEILARIQQLQRRCQSYTLSPHPPILAALHAQNQLTEEQSYRLSRVIEPPAASCPSSPRIRRRISLTKRLSAKLAREKSSSPSGSPGDPSSPTSSVSPGSPPSSPRSRDAPAGSPPASPGPQGPSTKLPLSLDLPSPRPFALPLGSPRIPLPAQQSSEARVIRVSIDNDHGNLYRSILLTSQDKAPSVVRRALQKHNVPQPWACDYQLFQVLPGDRGWEEMLISAIKSVGTFFGMFAMCQARFYR

SEQ ID NO: 2960 - protein, 102 aa, Homo sapiens
MVYTLYPFIHSMFFKNVILCNRCEAAAKLYLRIFSHLPNQSVLNKPGDLFFCAPWCTSDCCPSHRLSEATERTVALSISFLGLKNTMLPCNIIRDSTSISQL

SEQ ID NO: 2961 - protein, 127 aa, Homo sapiens [sequence omitted]

SEQ ID NO: 2962 - protein, 270 aa, Homo sapiens
MQGNNLQPPSPRPLECWSLHREAPQRTEASRTHPSPFLALPGSHRTANQAQVVPGLVHHPQENTQRLRIRAGLSPFPRARLAAIGSTHGHRWVPGICLPRCLCPASCALHACPPHCNNAEAHSWLRLGGPLQSRSVEHQQHACGWGWVTHATYGERGTSQAAERQRIAHTRALSVGNCPRSHFQCEFSSISKWSEGTGTFSPRPRAVKSGVGAQPSPHIRITWRSCTTLTSKPCSRAITPECVVGWSRRSRHWYSDMRTGECQGLSPITR

SEQ ID NO: 2963 - protein, 132 aa, Homo sapiens
MQSAGFTFVGGPSVEASHVARPRTRWERTAQVQRELWEVWLTTLRECGARKDLMCHHSISVMGRRRQVKGALGTYRAPAYWPGTVIVLGAMCHGSPLRGRGEAGGDRASVGLSSCSPRAQRQPNSCVQSEST

SEQ ID NO: 2964 - protein, 126 aa, Homo sapiens [sequence omitted]

SEQ ID NO: 2965 - protein, 540 aa, Homo sapiens [sequence omitted]

SEQ ID NO: 2966 - protein, 482 aa, Homo sapiens [sequence omitted]

SEQ ID NO: 2967 - protein, 370 aa, Homo sapiens [sequence omitted]

SEQ ID NO: 2968 - protein, 111 aa, Homo sapiens
MSELTSFCPPASMIRLKETSREVILHGNTFQLGLLFLVSVSIFKQSAYVLVFLSIYFAPTCKDSVIIRVPILSCTKIPEFLFLRQSLTLFPRLEGSGTISAHSNLHLLGFK

SEQ ID NO: 2969 - protein, 153 aa, Homo sapiens [sequence omitted]

SEQ ID NO: 2970 - protein, 420 aa, Homo sapiens
MSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPFYDCYEPMVRMAGATPVFIPLRSKPVYGKRWSSSDWTLDPQELESKFNSKTKAIILNTPHNPLGKVYNREELQVIADLCIKYDTLCISDEVYEWLVYSGNKHLKIATFPGMWERTITIGSAGKTFSVTGWKLGWSIGPNHLIKHLQTVQQNTIYTCATPLQEALAQAFWIDIKRMDDPECYFNSLPKELEVKRDRMVRLLESVGLKPIVPDGGYFIIADVSLLDPDLSDMKNNEPYDYKFVKWMTKHKKLSAIPVSAFCNSETKSQFEKFVRFCFIKKDSTLDAAEEIIKAWSVQKS

SEQ ID NO: 2971 - protein, 229 aa, Homo sapiens
MGGGPHADPAHRLQEHADGAGQAPATTALRTFLEATLEDIRAAHRSREQQLARAARSYHKRLVDLSRRHEELLVAYRAPGNPQAIFDIASLDLEPLPVPLVTDFSHREDQHGGPGALLSSPKKRPGGASQGGTSEPQGLDAASWAQIHQKLRDFSRSTQAELERERAQLLVRATMAEEQLSELQEYVDQHLGRYKHEILRLRKLAGTGDPWKVGAVPPAKPQHPRTGSH

SEQ ID NO: 2972 - protein, 105 aa, Homo sapiens
MLVHCVGLLLTGLLLGLTLGAGALLASEPIYQPPSAWVPAGGLVGLALLGALLTLRWPRPFTVLGTTLLGSAVLVACVDYFLEGLALGSWLGQRLQTLPALPSLC

SEQ ID NO: 2973 - protein, 204 aa, Homo sapiens
MELKQSLSTHLEAEKPLRRYGAVEETAWKTERLGRNQLDIISMAETTMMPEEIELEMAKIQRLREVLVRRESELRFMMDDIQLCKDIMDLKQELQNLVAIPEKEKTKLQKQREDELIQKIHKLVQKRDFLVDDAEVERLREQEEDKEMADFLRIKLKPLDKVTKSPASSRAEKKAEPPPSKPTVAKTGLALIKDCCGATQCNIM

SEQ ID NO: 2974 - protein, 385 aa, Homo sapiens
MSVQNSGWPHQEDSPKPQDPGPPANSDSDSGHLPGEDPEDTHAQGPAVLSLGSLCLDTNQAPNWTGLQTLLQQLPPQDIDERYCLALGEEERAELQLFCARRKQEALGQGVARLVLPKLEGHTCEKCRELLKPGEYGVFAARAGEQRCWHQPCFACQACGQALINLIYFYHDGQLYCGRHHAELLRPRCPACDQLIFSWRCTEAEGQRWHENHFCCQDCAGPLGGGRYALPGGSPCCPSCFENRYSDAGSSWAGALEGQAFLGETGLDRTEGRDQTSVNSATLSRTLLLAAAGGSSLQTQRGLPGSSPQQENRPGDKAEAPKGQEQCRLETIRDPKDTPFSTCSSSSDSEPEGFFLGERLPQSWKTPGSLQAEDSNASKTHCTMC

SEQ ID NO: 2975 - protein, 141 aa, Homo sapiens
MTIMVEDIMKLLCSLSGERKMKAAVKHSGKGALVTGAMAFVGGLVGGPPGLAVGGAVGGLLGAWMTSGQFKPVPQILMELPPAEQQRLFNEAAAIIRHLEWTDAVQLTALVMGSEALQQQLLAMLVNYVTKELRAEIQYDD

SEQ ID NO: 2976 - protein, 340 aa, Homo sapiens [sequence omitted]

SEQ ID NO: 2977 - protein, 657 aa, Homo sapiens
MGEEDYYLELCERPVQFEKANPVNCVFFDEANKQVFAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPERAVILLSTTVLENVLQPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIVFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVEKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 2978 - protein, 275 aa, Homo sapiens
MATAAGLDSAGPQDAREVSPEPIVSTVARLKSSLAQPDRRYSEPSMPSSQECLESRVTNQTLTKSEGDFPVPRVGSRLESEEAEDPFPEEVFPAVQGKTKRPVDLKIKNLAPGSVLPRALVLKAFSSSSLDASSDSSPVASPSSPKRNFFSRHQSFTTKTEKGKPSREIKKHSMSFTFAPHKKVLTKNLSAGSGKSQDFTRDHVPRGVRKESQLAGRIVQENGCETRNQTARGFCLRPHALSVDDVFQGADWERPGSPPSYEEAMQGPAARPWGA

SEQ ID NO: 2979 - protein, 104 aa, Homo sapiens
MRLFYYGGIFESGVGRGFLIVIQVHLVFFDLFTIYWCVTWGLSRVSSLLRVFLSELEDCLILGSGVQIFHQQFLSVFTRIISFCLLCRKVVGEKGQKEEREPFM

SEQ ID NO: 2980 - protein, 221 aa, Homo sapiens
MELAGGVPLDQCQGLSQDLRNQICFQLLTLCLRELFEFRFMQTDPNWANFLYDASSHQVTLLDFGASRGFGTEFTDHYIEVVKAAADGDRDCVLQKSRDLKFLTGFETKAFSDAHVEAVMILGEPFATQGPYDFGSGETTRRIQDLIPVLLRHRLCPPPEETYALHRKLAGAFLACAHLRAHIACRDLFQDTYHRYWASRQPDAATAGSLPTKGDSWVDPS

SEQ ID NO: 2981 - protein, 581 aa, Homo sapiens
MSNPRKRSIPMRDSNTGLEQLLAEDSFDESDFSEIDDSDNFSDSALEADKIRPLSHLESDGKSSTSSDSGRSMKWSARAMIPRQRYDFTGTPGRKVDVSDITDPLQYFELFFTEELVSKITRETNAQAALLASKPPGPKGFSRMDKWKDTDNDELKVFFAVMLLQGIVQKPELEMFWSTRPLLDTPYLRQIMTGERFLLLFRCLHFVNNSSISAGQSKAQISLQKIKPVFDFLVNKFSTVYTPNRNIAVDESLMLFKGPLAMKQYLPTKRVRFGLKLYVLCESQSGYVWNALVHTGPGMNLKDSADGLKSSRIVLTLVNDLLGQGYCVFLDNFNISPMLFRELHQNRTDAVGTARLNRKQIPNDLKKRIAKGTTVARFCGELMALKWCDGKEVTMLSTFHNDTVIEVNNRNGKKTKRPRVIVDYNENMGAVDSADQMLTSYPSERKRHKVWYKKFFHHLLHITVLNSYILFKEDNPEHTMSHINFRLALIERMLEKHHKPGQQHLRGRPCSDDVTPLRLSGRHFPKSIPATSGKQNPTGRCKICCSQYDKDGKRIRKETRYFCAECDVPLCVVPCFEIYHT

SEQ ID NO: 2982 - protein, 128 aa, Homo sapiens [sequence omitted]

SEQ ID NO: 2983 - protein, 397 aa, Homo sapiens
MSWLFPLTKSASSSAAGSPGGLTSLQQQKQRLIESLRNSHSSIAEIQKDVEYRLPFTINNLTININILLPPQFPQEKPVISVYPPIRHHLMDKQGVYVTSPLVNNFTMHSDLGKIIQSLLDEFWKNPPVLAPTSTAFPYLYSNPSGMSPYASQGFPFLPPYPPQEANRSITSLSVADTVSSSTTSHTTAKPAAPSFGVLSNLPLPIPTVDASIPTSQNGFGYKMPDVPDAFPELSELSVSQLTDMNEQEEVLLEQFLTLPQLKQIITDKDDLVKSIEELARKNLLLEPSLEAKRQTVLDKYELLTQMKSTFERKMQRQHELSESCSASALQARLKVAAHEAEEESDNIAEDFLEGKMEIDDFLSSFMEKRTICHCRRAKEEKLQQAIAMHSQFHAPL

SEQ ID NO: 2984 - protein, 441 aa, Homo sapiens
MAAATLRDPAQGYVTFEDVAVYFSQEEWRLLDDAQRLLYRNVMLENFTLLASLGLASSKTHEITQLESWEEPFMPAWEVVTSAILRGSWQGAKAEAAAEQSASVEVPSSNVQQHQKQHCGEKPLKRQEGRVPVLRSCRVHLSEKSLQSREVGKDLLTSSGVLKHQVTHTGEKSHRSSKSREAFHAGKRHYKCSECGKAFGQKYLLVQHQRLHTGEKPYECSECGKLFSHKSNLFIHQIVHTGERPYGCSDCGKSFSRNADLIQHQRVHTGEKPFTCSECGKAFRHNSTLVQHHRIHTGVRPYECSECGKLFSFNSSLMKHQRVHTGERPYKCSECGKFYSHKSSLINHWRVHTGERPYECSECGKFFSQSSSLMQHRKVHTGEKPFKCNECGRFFSENSSLVKHQRVHTGAKPYECRECGKFFRHSSSLVKHRRIHTGEIQ

SEQ ID NO: 2985 - protein, 297 aa, Homo sapiens
MGRKKIQISRILDQRNRQVTFTKRKFGLMKKAYELSVLCDCEIALIIFNSANRLFQYASTDMDRVLLKYTEYSEPHESRTNTDILEVPQTLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPEYGLGDPPPPPGLLQPPTLAPWQPSRGDGPPAVSSQPR

SEQ ID NO: 2986 - protein, 107 aa, Homo sapiens
MGCSTSMGACLRPATARSPSATCTAWTCTGWRRGRPWWRWTQDVATTVPQPPPPASAALTCMCVHSAFEETQEWLEETDSEEDSEEVEGAEGGVDDEDSGEESGAED

SEQ ID NO: 2987 - protein, 174 aa, Homo sapiens
MAALMTPGTGAPPAPGDFSGEGSQGLPDPSPEPKQLPELIRMKRDGGRLSEADIRGFVAAVVNGSAQGAQIGAWGGLGVPDPDWEVSPRDFGSLGVRRCPTTSTGPRVPHRCGLPPSRVPPHTRGHADGHPTSGHGSGGDLGADPGPGSVGTAAGVARGLAPAACGQAFHRGCG

SEQ ID NO: 2988 - protein, 104 aa, Homo sapiens [sequence omitted]

SEQ ID NO: 2989 - protein, 621 aa, Homo sapiens
MCSGWSSSVIWRHTQFAVERCGFCGSSGPGAPLEPSTLGSKHLPWEAVSAGFADRNRNMDGAMWLSLCPDNEDLLWRKKHKLLQARGKGDLALQRRADAKLWKNYQLQRLAEELRRGYQEAQHLHVGGLDRLQSARLLGWGGGRARENEPDSQGPIQRRSARPPRAKEKHRAALSEERSCREELGQQHPRHSRPRKTAASPEKPQTTKATGRMNSHLAPPEKRKGRPEPSTKSGGGRCAIHPRRSKGADLERSNPLVAAVGEIGLVEEKEKGTARAGRRQLGKGAVCFVPALTSRSQGQSLEGKLRDLGQLWPADSSCRREAVSPASQCTLREKNKWQKELELAFEELFNINRKLKKHLCLYLALKPRMDQRPGEGHAFSEMQECGAGTPRGKKMADPEMLPAGEPRSPAEEEAQQAASKTDLKTFMGKAQNQKYQGTVKPTFRNGSQTLSPEAGIFINKEDSLLYSTESGQETPKLGTLAEGSLQLHLQDQADRVGSTASRQRQKAEMEQRRQKQLESLEQMEHPDMSLEIHYKAELEKERREQRRARLAHLKSSSTRAQERERGSELSTTSPSGTSLADDDRHSQMIRDQQQQILQQNRLHKQFLEEARKCLREFQNIC

SEQ ID NO: 2990 - protein, 562 aa, Homo sapiens
MDLPEGPVGGPTAEMYLRERPEEARLGMPVSLEEQILNSTFEACDPQRTGTVAVAQVLAYLEAVTGQGPQDARLQTLANSLDPNGEGPKATVDLDTFLVVMRDWIAACQLHGGLELEEETAFQGALTSRQLPSGCPEAEEPANLESFGGEDPRPELQATADLLSSLEDLELSNRRLVGENAKLQRSMETAEEGSARLGEEILALRKQLHSTQQALQFAKAMDEELEDLKTLARSLEEQNRSLLAQARQAEKEQQHLVAEMETLQEENGKLLAERDGVKKRSQELAMEKDTLKRQLFECEHLICQRDTILSERTRDVESLAQTLEEYRVTTQELRLEISRLEEQLSQTYEGPDELPEGAQLRRVGWTELLPPSLGLEIEAIRQKQEVATADLSNPLCGVWQWEEVIHETSEETEFPSEAPAGGQRNFQGEPAHPEEGRKEPSMWLTRREEEEDAESQVTADLPVPLGAPRPGDIPENPPERPARRELQQALVPVMKKLVPVRRRAWGQLCLPPQRLRVTRHPLIPAPVLGLLLLLLLSVLLLGPSPPPTWPHLQLCYLQPPPV

SEQ ID NO: 2991 - protein, 740 aa, Homo sapiens
MNPPGSLEALDPNVDEHLSTQILAPSVHSDNSQERIQARRLRIAARLEARRREALGEYLDGKKESEEDQSKSYKQKEESRLKLAKLLLCGTELVTNIQVAIDIREIHRRVEEEEIKRQRIEKLENEVKTSQDKFDEITSKWEEGKQKRIPQELWEMLNTQQLHCAGLLEDKNKLISELQQELKTKDDQYVKDLKKQSDDICLLLERMEEQVKNVMKTFREELYNIEKAFEVERQELLASNKKKWEQALQAHNAKELEYLNNRMKKVEDYEKQLNRQRIWDCEEYNMIKIKLEQDVQILEQQLQQRKAIYQLNQEKLEYNLQVLKKRDEESTVIKSQQKRKINRLHDILNNLRSKYAKQIKQFQEENQSLTSDYKRLVMQFKELQKAMRHFALIDDEKFREIWLMNEEEAKDLIARAFDVDRIIHTHHLGLPWAAPDFWFLNNVGPISQQPQKSATQIVEEMLMRSEEEEAEEAAAEPESYLDLPKQISEKTTKRILMLLCDESGFLIESKLLSLLLPLEQNECYLLRLDAIFSALGIESEDDLYKLVNFFLKYRAHRLSSSLQIKPCSQASMEKASMEETSTRSELELAEQTEMEGEKEESLVEGEKEEEEETPPSPWVIHPNDVLKILEAFVMGLKKPRDSRAPLRVQKNVRDNSKDSEYWQALTTVIPSSKQNLWDALYTALEKYHLVLTQRAKLLLENSSLEQQNTELQALLQQYLNSKINSELQVPPTQVLRVPTK

SEQ ID NO: 2992 - protein, 379 aa, Homo sapiens [sequence omitted]

SEQ ID NO: 2993 - protein, 614 aa, Homo sapiens
MEMESAAASTRFHQPHMERKMSAMACEIFNELRLEGKLCDVVIKVNGFEFSAHKNILCSCSSYFRALFTSGWNNTEKKVYNIPGISPDMMKLIIEYAYTRTVPITPDNVEKLLAAADQFNIMGIVRGCCEFLKSELCLDNCIGICKFTDYYYCPELRQKAYMFILHNFEEMVKVSAEFLELSVTELKDIIEKDELNVKQEDAVFEAILKWISHDPQNRKQHISILLPKVRLALMHAEYFMNNVKMNDYVKDSEECKPVIINALKAMYDLNMNGPSNSDFTNPLTRPRLPYAILFAIGGWSGGSPTNAIEAYDARADRWVNVTCEEESPRAYHGAAYLKGYVYIIGGFDSVDYFNSVKRFDPVKKTWHQVAPMHSRRCYVSVTVLGNFIYAMGGFDGYVRLNTAERYEPETNQWTLIAPMHEQRSDASATTLYGKVYICGGFNGNECLFTAEVYNTESNQWTVIAPMRSRRSGIGVIAYGEHVYAVGGFDGANRLRSAEAYSPVANTWRTIPTMFNPRSNFGIEVVDDLLFVVGGFNGFTTTFNVECYDEKTDEWYDAHGMSIYRSALSCCVVPGLANVEEYAARRDNFPGLALRDEVKYSASTSTLPVRASSFS

SEQ ID NO: 2994 - protein, 605 aa, Homo sapiens
MSQLSSTLKRYTESARYTDAHYAKSGYGAYTPSSYGANLAASLLEKEKLGFKPVPTSSFLTRPRTYGPSSLLDYDRGRPLLRPDITGGGKRAESQTRGTERPLGSGLSGGSGFPYGVTNNCLSYLPINAYDQGVTLTQKLDSQSDLARDFSSLRTSDSYRIDPRNLGRSPMLARTRKELCTLQGLYQTASCPEYLVDYLENYGRKGSASQVPSQAPPSRVPEIISPTYRPIGRYTLWETGKGQAPGPSRSSSPGRDGMNSKSAQGLAGLRNLGNTCFMNSILQCLSNTRELRDYCLQRLYMRDLHHGSNAHTALVEEFAKLIQTIWTSSPNDVVSPSEFKTQIQRYAPRFVGYNQQDAQEFLRFLLDGLHNEVNRVTLRPKSNPENLDHLPDDEKGRQMWRKYLEREDSRIGDLFVGQLKGSLTCTDCGYCSTVFDPFWDLSLPIAKRGYPEVTLMDCMRLFTKEDVLDGDEKPTCCRCRGRKRCIKKFSIQRFPKILVLRLKRFSESRIRTSKLTTFVNFPLRDLDLREFASENTNHAVYNLYAVSNHSGTTMGGHYTAYCRSPGTGEWHTFNDSSVTPMSSSQVRTSDAYLLFYELASPPSRM

SEQ ID NO: 2995 - protein, 234 aa, Homo sapiens
MEGASRNLASTPRVHAKVMMYRKEQYLDVLHALKVVRFVSDATPQAEVYLRMYQLESGKLPRSPSFPLEPDDEVFLAIAKAMEEMVEDSVDCYWITRRFVNQLNTKYRDSLPQLPKAFEQYLNLEDGRLLTHLRMCSAAPKLPYDLWFKRCFAGCLPESSLQRVWDKVVSGSCKILVFVAVEILLTFKIKVMALNSAEKITKFLENIPQDSSDAIVSKAIDLWHKHCGTPVHSS

SEQ ID NO: 2996 - protein, 204 aa, Homo sapiens [sequence omitted]

SEQ ID NO: 2997 - protein, 457 aa, Homo sapiens
MTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYLFNCDCLIPLKRKRKYFKVFEVTKTTESFASKVQSLVPVKYEVIVTTGYEPGAGTDANVFVTIFGANGDTGKRELKQKMRNLFERGSTDRFFLETLELGELRK

SEQ ID NO: 2998 - protein, 503 aa, Homo sapiens
MPDVKESVPPKYPGDSEGRSCKPETSGPPQEDKSGSEDPPPFLSVTGLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 2999 - protein, 378 aa, Homo sapiens [sequence omitted]

SEQ ID NO: 3000 - protein, 349 aa, Homo sapiens
MAIPITVLDCDLLLYGRGHRTLDRFKLDDVTDEYLMSMYGFPRQFIYYLVELLGANLSRPTQRSRAISPETQVLAALGFYTSGSFQTRMGDAIGISQASMSRCVANVTEALVERASQFIRFPADEASIQALKDEFYGLAGMPGVMGVVDCIHVAIKAPNAEDLSYVNRKGLHSLNCLMVCDIRGTLMTVETNWPGSLQDCAVLQQSSLSSQFEAGMHKDSWLLGDSSFFLRTWLMTPLHIPETPAEYRYNMAHSATHSVIEKTFRTLCSRFRCLDGSKGALQYSPEKSSHIILACCVLHNISLEHGMDVWSSPMTGPMEQPPEEEYEHMESLDLEADRIRQELMLTHFS

SEQ ID NO: 3001 - protein, 418 aa, Homo sapiens
MHPEPSEPATGGAAELDCAQEPGVEESAGDHGSAGRGGCKEEINDPKEICVGSSDTSYHSQQKQSGDNGSGGHFAHPREDREDRGPRMTKSSLQKLCKQHKLYITPALNDTLYLHFKGFDRIENLEEYTGLRCLWLQSNGIQKIENLEAQTELRCLFLQMNLLRKIENLEPLQKLDALNLSNNYIKTIENLSCLPVLNTLQMAHNHLETVEDIQHLQECLRLCVLDLSHNKLSDPEILSILESMPDLRVLNLMGNPVIRQIPNYRRTVTVRLKHLTYLDDRPVFPKDRACAEAWARGGYAAEKEERQQWESRERKKITDSIEALAMIKQRAEERKRQRESQERGEMTSSDDGENVPASAEGKEEPPGDRETRQKMELFVKESFEAKDELCPEKPSGEEPPVEAKREDGDPATVTACEG

SEQ ID NO: 3002 - protein, 119 aa, Homo sapiens
MLVIQLQAKSKRIGAQTEKTAVGVRGEKTEREAGKKGMGRKPGKRMERESSELRKAAQKCKIWKQMERIVKSRTGHTSFKIQPLKRIYSKPRLYGEENEGPCGETLAKIICRELMADLG

SEQ ID NO: 3003 - protein, 283 aa, Homo sapiens
MEWKLEQSMREQALLKAQLTQLKESLKEVQLERDEYAEHLKGERARWQQRMRKMSQEVCSLKKEKKHDKYRVEKLERSLSKLKHQMAGPLPPEPPAVPSEVELQHLRKELERVAGELQAQVEKEELGFFQYYRERCHQKVYHPITKPGGCAKDAAPGGGHHQAGPGQGGDEGEAAGAAGDGVAAGGDYKGHSKFLVTAQNPAHEPSPGAPAPQELGAAHKHGDLCEVSLTDSVEPVQGEAREGSPHDNPTAQPIVQDHQEHPGLGSNCCVPFFCWAWLPRRRR

SEQ ID NO: 3004 - protein, 109 aa, Homo sapiens
MRERERKRGRKKKKREKEKGRKKEGKKERKKEKGRTNEWERERQKERRRERKKTKEKERGQAWWLTPVIPALWEAEVGGSGVQNQPGQHGETPCLLKLQKLAGRGGGRQ

SEQ ID NO: 3005 - protein, 690 aa, Homo sapiens
MSAENNQLSGASPPHPPTTPQYSTQNLPSEKEDTEVELDEESLQDESPFSPEGESLEDKEYLEEEEDLEEEEYLGKEEYLKEEEYLGKEEHLEEEEYLEKVGYLEEEEYIEEEEYLGKEGYLEEEEYLGKEEHLGKEGYLEKEDYIEEVDYLGKKAYLEEEEYLGKKSYLEKEKALEKEENLEEEEALEKEENLDGKENLYKKYLKEPKASYSSQTMLLRDARSPDAGPSQVTTFLTVPLTFATPSPVSESATESSELLLTLYRRSQASQTDWCYDRTAVKSLKSKSETEQETTTKLAPEEHVNTKVQQKKEENVLEFASKENFWDGITDESIDKLEVEDLDENFLNSSYQTVFKTIIKEMAAHNELEEDFDIPLTKLLESENRWKLVIMLKKNYEKFKETILRIKRRREAQKLTEMTSFTFHLMSKPTPEKPETEEIQKPQRVVHHRKKLERDKEWIQKKTVVHQGDGKLILYPNKNVYQILFPDGTGQIHYPSGNLAMLILYAKMKKFTYIILEDSLEGRIRALINNSGNATFYDENSDIWLNLSSNLGYYFPKDKRQKAWNWWNLNIHVHAPPVQPISLKINEYIQVQIRSQDKIIFCFTYEQKQICLNLGTRYKFVIPEVLSEMKKKTILEAEPGPTAQKIRVLLGKMNRLLNYATTPDLENFIEAVSISLMDNKYLKKMLSKLWF

SEQ ID NO: 3006 - protein, 131 aa, Homo sapiens
MIFILWPWCYSVLIPQSSQDVLFQEFVTFEDVAVHLTREEWGYLDPVQRDLYREVMLENYGNVVSLGILLRLPTTRIHSVNSCPALSHTQASAFSGETLAVLTAGISKRWPKYRLPIDIARPCSETPFPRL

SEQ ID NO: 3007 - protein, 484 aa, Homo sapiens
MVPVQPAEPPEVLKSEPYGEKADVWAVGCILYQMATLSPPFYSTNMLSLATKIVEAVYEPVPEGIYSEKVTDTISRCLTPDAEARPDIVEVSSMISDVMMKYLDNLSTSQLSLEKKLERERRRTQRYFMEANRNTVTCHHELAVLSHETFEKASLSSSSSGAASLKSELSESADLPPEGFQASYGKDEDRACDEILSDDNFNLENAEKDTYSEVDDELDISDNSSSSSSSPLKESTFNILKRSFSASGGERQSQTRDFTGGTGSRPRPALLPLDLLLKVPPHMLRAHIKEIEAELVTGWQSHSLPAVILRNLKDHGPQMGTFLWQASAGIAVSQRKVRQISDPIQQILIQLHKIIYITQLPPALHHNLKRRVIERFKKSLFSQQSNPCNLKSEIKKLSQGSPEPIEPNFFTADYHLLHRSSGGNSLSPNDPTGLPTSIELEEGITYEQMQTVIEEVLEESGYYNFTSNRYHSYPWGTKNHPTKR

SEQ ID NO: 3008 - protein, 412 aa, Homo sapiens
MSPCRPVRIKWLQDGSQSLFGRLHNDCIYILIDTSHSMKSKLDLVKDKIIQFIQEQLKYKSKFNFVKFDGQAVAWREQLAEVNEDNLEQAQSWIRDIKIGSSTNTLSALKTAFADKETQAIYLLTDGRPDQPPETVIDQVKRFQEIPIYTISFNYNDEIANRFLKEVAALTGGEFHFYNFGCKDPTPPEAVQNEDLTLLVKEMEQGHSDLEKMQDLYSESLIMDWWYNAEKDGDSKHQKEICSMISTPEKCAKPQSDVDSTQTSSLNMLKGPWGLSDQKVQKKKVLHAESTKTSLLRSQMSSLRSSACSERKDGLSNASSRRTALSDKEMSILLAEEWLDDKSSEKVTREGSQVYDHDSSDVSSENWLKTYGLVAKKLTLMDALSVAAVPHSSTYVPVLDKHVVSKVFDEVN

SEQ ID NO: 3009 - protein, 197 aa, Homo sapiens
MQGRRELGGEPLSDLQEEAASASLRVAPERLSDDSLEWRRTCPDLLLSDGKASISMPREGGSTCTARCPDPGEHSSTWGEFEGFRESSAKSGQFSQSLELLEGPTEPQPPRTTSAPKECSSHQPCQGGPWVTGTSAVPPSEPILSYENILKCAFQEITVQQAAEDVSTIDHFLEISSEEKPGVERVHKLWDTLSTEH

SEQ ID NO: 3010 - protein, 648 aa, Homo sapiens
MLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKKSVMKTTWGVLDPPVGNTRLNVIRLISSLLQTNTSSINGDLMELNSIGVILNMFFKYTWNNFLHTQVEICIALILASPFENTENATITDQDSTGDNLLLKHLFQKCQLIERILEAWEVNEKKQAEGGRRHGYMGHLTRIANCIVHSTDKGPNSALVQQLIKDLPDEVRERWETFCTSSLGETNKRNTVDLVTTCHIHSSSDDEIDFKETGFSQDSSLQQAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 3011 - protein, 156 aa, Homo sapiens
MAAAGAFRLRRAASALLLRSPRLPARELSAPARLYHKKVVDHYENPRNVGSLDKTSKNVGTGLVGAPACGDVMKLQIQVDEKGKIVDARFKTFGCGSAIASSSLATEWVKGKTVEEALTIKNTDIAKELCLPPVKLHCSRKEGMRNISLNASMEVY

SEQ ID NO: 3012 - protein, 213 aa, Homo sapiens
MNPGSPTLPAVKQAGDDSQGVCIPVGSCLVRFDLLGSPLTELSMHQDLSQGHEVQLPPVNRSLKPNQKANPTPPNLRNNRVINELSFKPPVTEPWSGTSHTFDSSSSQHPISTQSITNTDSEDSGERYLFPNPASAFPVSGGTSSSAPPRSTGNIHYAALDFQPSKPSIGSVTSGKKVDYVQVDLEKTQALQKTMHEQMCLRQSSEPPRGAKL

SEQ ID NO: 3013 - protein, 443 aa, Homo sapiens
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVLQGMSQLHFYRFYLEFGCLRKAFRHKFRLPPPSSDFLADVVGLQTEQRAGDLPKTMEGPLPSNAKAAINLQDDPIIQKYGSKKVGLTRCLLTKEEMRTFHFPLQGFPDCENSLLTKCNGSIADNSPLFGLDCEMCLTSKGRELTRISLVAEGGCCVMDELVKPENKILDYLTSFSGITKKILNPVTTKLKDVQRQLKALLPPDAVLVGHSLDLDLRALKMIHPYVIDTSLLYVREQGRRFKLKFLAKVILGKDIQCPDRLGHDATEDARTILELARYFLKHGPKKIAELNLEALANHQEIQAAGQEPKNTAEVLQHPNTSVLECLDSVGQKLLFFDPGDRCW

SEQ ID NO: 3014 - protein, 260 aa, Homo sapiens [sequence omitted]

SEQ ID NO: 3015 - protein, 119 aa, Homo sapiens [sequence omitted]

SEQ ID NO: 3016 - protein, 188 aa, Homo sapiens [sequence omitted]

SEQ ID NO: 3017 - protein, 209 aa, Homo sapiens [sequence omitted]

SEQ ID NO: 3018 - protein, 305 aa, Homo sapiens
MGPCRQEAAGQASLCLSERPPGEKRPGWAQATAGAHWTPSVSNHPSPVPKATSLPWFPPRSCTLPCQSPSASAHSSLRLENSSTDGSRSRFHCCLLQKPSLTTCPSAVFSLPVTVWRFCWLTRLPRHPWGPPEGAAPHPPRLTTSWALLCSSKAWAACCCRYRNSCCRRKCCCEKSCSCWAWCRGLRPGGYRAGQRGGTVARSISSAAGTETVRCTCGLMLHHHAHYEGKLKPERGHTHTVGSWALCGPPAAPQGPGSLSCPPWATCAPQARGTQPCPHPGWDVPTASQPEQVSTQTRTRTTVRT

SEQ ID NO: 3019 - protein, 395 aa, Homo sapiens
MDLCQKNETDLENAENNEIQFTEETEPTYTCPDGKSEKNHVYCLLDVSDITLEQDEKAKEFIIGTGWEEAVQGWGRTSPAACIWPRKIPKKARVGEGACSDCLVCVNLSHWSLQTKPPTEGGPEKDQSSPSQTQAAPQGPSTASRAISDICFPTYFRAEKKSLQIKEFIWCNKDWAIPGTNRGKASGNPSGGAHRGLSIPGPLTSRALLVLPPLKALLSNALDVLGKKSKNSFLQSEEKVLDVEKDGCVAYAYGLKTADGKGEKRASELAKHPMVNDTPSSPSPAAQISLLTDPEQRCLHWSLLSEKNLACPPDPSNVRYLAALQLLQKRGVQSYKSKFKAKEPRSPVITRKHVLPKAKQENRPQMLETKVFPRPVLPSLTVSRVIIPVSTHRIL

SEQ ID NO: 3020 - protein, 479 aa, Homo sapiens
MDATIAPHRIPPEMPQYGEENHIFELMQNMLEQLLIHQPEDPIPFMIQHLHRDNDNVPRIVILGPPASGKTTIAMWLCKHLNSSLLTLENLILNEFSYTATEARRLYLQRKTVPSALLVQLIQERLAEEDCIKQGWILDGIPETREQALRIQTLGITPRHVIVLSAPDTVLIERNLGKRIDPQTGEIYHTTFDWPPESEIQNRLMVPEDISELETAQKLLEYHRNIVRVIPSYPKILKVISADQPCVDVFYQALTYVQSNHRTNAPFTPRVLLLGPVGSGKSLQAALLAQKYRLVNVCCGQLLKEAVADRTTFGELIQPFFEKEMAVPDSLLMKVLSQRLDQQDCIQKGWVLHGVPRDLDQAHLLNRLGYNPNRVFFLNVPFDSIMERLTLRRIDPVTGERYHLMYKPPPTMEIQARLLQNPKDAEEQVKLKMDLFYRNSADLEQLYGSAITLNGDQDPYTVFEYIESGIINPLPKKIP

SEQ ID NO: 3021 - protein, 345 aa, Homo sapiens
MNALHYAAYFDVPELIRVILKTSKPKDVDATCSDFNFGTALHIAAYNLCAGAVKCLLEQGANPAFRNDKGQIPADVVPDPVDMPLEMADAAATAKEIKQMLLDAVPLSCNISKAMLPNYDHVTGKAMLTSLGLKLGDRVVIAGQKVGTLRFCGTTEFASGQWAGIELDEPEGKNNGSVGKVQYFKCAPKYGIFAPLSKISKAKGRRKNITHTPSTKAAVPLIRSQKIDVAHVTSKVNTGLMTSKKDSASESTLSLPPGEELKTVTEKDVALLGSVSSCSSTSSLEHRQSYPKKQNAISSNKKTMSKSPSLSSRASAGIYGFFNQAFLVFFILVCLFEFLSNIYSK

SEQ ID NO: 3022 - protein, 701 aa, Homo sapiens
MDSQELKTLINYYCQERYFHHVLLVASEGIKRYGSDPVFRFYHAYGTLMEGKTQEALREFEAIKNKQDVSLCSLLALIYAHKMSPNPDREAILESDARVKEQRKGAGEKALYHAGLFLWHIGRHDKAREYIDRMIKISDGSKQGHVLKAWLDITRGKEPYTKKALKYFEEGLQDGNDTFALLGKAQCLEMRQNYSGALETMNQIIVNFPSFLPAFVKKMKLQLALQDWDQTVETAQRLLLQDSQNVEALRMQALYYVCREGDIEKASTKLENLGNALDAMEPQNAQLFYNITLAFSRTCGRSQLILQKIQTLLERAFSLNPQQSEFATELGYQMILQGRVKEALKWYKTAMTLDETSVSALVGFIQCQLIEGQLQDADQQLEFLNEIQQSIGKSAELIYLHAVLAMKKNKRQEEVINLLNDVLDTHFSQLEGLPLGIQYFEKLNPDFLLEIVMEYLSFCPMQPASPGQPLCPLLRRCISVLETVVRTVPGLLQTVFLIAKVKYLSGDIEAAFNNLQHCLEHNPSYADAHLLLAQVYLSQEKVKLCSQSLELCLSYDFKVRDYPLYHLIKAQSQKKMGEIADAIKTLHMAMSLPGMKRIGASTKSKDRKTEVDTSHRLSIFLELIDVHRLNGEQHEATKVLQDAIHEFSGTSEEVRVTIANADLALAQGGIERALSILQNVTAEQPYFIEAREKMADIYLKH

SEQ ID NO: 3023 - protein, 103 aa, Homo sapiens
MVVLPPPLSLRQPAIVPMGADMRSRSRLPAASASGISPRVGSRLSLPRGNLGLGPIARERALLAPAPPAPSLLSWLSQVQGPPGVTWGTTCLKAVNNSWKRSC

SEQ ID NO: 3024 - protein, 648 aa, Homo sapiens
MWVQGHSSRASATESVSFSGIVQMDEDTHYDKVEDVVGSHIEDAVTFWAQSINRNKDIMKIGCSLSEVCPHASSVLGNLDPNKIYGGLFSEDQCWYRCKVLKIISVEKCLVRYIDYGNTEILNRSDIVEIPLELQFSSVAKKYKLWGLHIPSDQEVTQFDQGTTFLGSLIFEKEIKMRIKATSEDGTVIAQAEYGSVDIGEEVLKKGFAEKCRLASRTDICEEKKLDPGQLVLRNLKSPIPLWGHRSNQSTFSRPKGHLSKKMTLDLNDENDAGNLITFPKESLAVGDFNLGSNVSLEKIKQDQKLIEENEKLKTEKDALLESYKALELKVEQIAQELQQEKAAAVDLTNHLEYTLKTYIDTRMKNLAAKMEILKEMRHVDISVRFGKDLSDAIQVLDEGCFTTPASLNGLEIIWAEYSLAQENIKTCEYVSEGNILIAQRNEMQQKLYMSVEDFILEVDESSLNKRLKTLQDLSVSLEAVYGQAKEGANSDEILKKFYDWKCDKREEFTSVRSETDASLHRLVAWFQRTLKVFDLSVEGSLISEDAMDNIDEILEKTESSVCKELEIALVDQGDADKEIISNTYSQVLQKIHSEERLIATVQAKYKDSIEFKKQLIEYLKKIPSVDHLLSIKKTLKSLKALLRWKLV

SEQ ID NO: 3025 - protein, 673 aa, Homo sapiens [sequence omitted]

SEQ ID NO: 3026 - protein, 342 aa, Homo sapiens
MADKMVRTPKCSRCRNHGFLVPVKGHAGKCRWKQCLCEKCYLISERQKIMAAQKVLKTQAAEEEQEAALCAQGPKQASGAAAAAPAPVPVPAASLRPLSPGTPSGDADPGPEGRAAACFFEQPPRGRNPGPRALQPVLGGRSHVEPSERAAVAMPSLAGPPFGAEAAGSGYPGPLDLRRPMRTVPGPLFTDFVRPLNINPDRALGPEYPGGSSMHPYCPFPLGYLDAPPGVPLQQGFRHVSRSQYQGGGLVSEPGGDFQPSYYLPPPPPPLPPLPPLPPQPQFLPPGYLSALHFLPPPPPPPPPSSFSLTVLFDTDKENTDDQDAEVLSGEPSQPSSQEQSD

SEQ ID NO: 3027 - protein, 278 aa, Homo sapiens
MMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQVSTEEALAGALIPLLPSQPHPDPD

SEQ ID NO: 3028 - protein, 1081 aa, Homo sapiens [sequence omitted]

SEQ ID NO: 3029 - protein, 138 aa, Homo sapiens
MCFMSSSCSKDCPPTCAGSTFGQGGMRELPTISHLRTAFLRSLPHKLQERHGRHTTFQWVAMSSCQLERSSPGKYLYLGRESFSLCSPAVLKWKSRNPDVGPNTLSRTASSAGPQRGSELGGPPTLPAHIPASWNPGP

SEQ ID NO: 3030 - protein, 287 aa, Homo sapiens
MEFNPSDHPRASTIFLSKSQTDVREKRKSLFINHHPPGQIARKYSSCSTIFLDDSTVSQPNLKYTIKCVALAIYYHIKNRDPDGRMLLDIFDENLHPLSKSEVPPDYDKHNPEQKQIYRFVRTLFSAAQLTAECAVVTLVYLERLLTYAEIDICPANWKRIVLGAILLASKVWDDQAVWNVDYCQILKDITVEDMSELERQFLELLQFNINVPSSVYAKYYFDLRSLAEANNLSFPLEPLSRERAHKLEAISRLCEDKYKDLRRSARKRSASADNLTLPRWSPAIIS

SEQ ID NO: 3031 - protein, 424 aa, Homo sapiens [sequence omitted]

SEQ ID NO: 3032 - protein, 195 aa, Homo sapiens
MEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKGGLSFCRLLLQGVPPNIIDSYLRDLHSSNPEEY

SEQ ID NO: 3033 - protein, 110 aa, Homo sapiens [sequence omitted]

SEQ ID NO: 3034 - protein, 296 aa, Homo sapiens
MVAEKETLSLNKCPDKMPKRTKLLAQQPLPVHQPHSLVSEGFTVKAMMKNSVVRGPPAAGAFKERPTKPTAFRKFYERGDFPIALEHDSKGNRIAWKVEIEKLDYHHYLPLFFDGLCEMTFPYEFFARQGIHDMLEHGGNKILPVLPQLIIPIKNALNLRNRQVICVTLKVLQHLVVSAEMVGKALVPYYRQILPVLNIFKNMNGSYSLPRLECSGAIMARCNLDHLGSSDPPTSASQVAEIIVNSGDGIDYSQQKRENIGDLIQETLEAFERYGGENAFINIKYVVPTYESCLLN

SEQ ID NO: 3035 - protein, 514 aa, Homo sapiens
MGKDFRYYFQHPWSRMIVAYLVIFFNFLIFAEDPVSHSQTEANVIVVGNCFSFVTNKYPRGVGWRILKVLLWLLAILTGLIAGKFLFHQRLFGQLLRLKMFREDHGSWMTMFFSTILFLFIFSHIYNTILLMDGNMGAYIITDYMGIRNESFMKLAAVGTWMGDFVTAWMVTDMMLQDKPYPDWGKSARAFWKKGNVRITLFWTVLFTLTSVVVLVITTDWISWDKLNRGFLPSDEVSRAFLASFILVFDLLIVMQDWEFPHFMGDVDVNLPGLHTPHMQFKIPFFQKIFKEEYRIHITGKWFNYGIIFLVLILDLNMWKNQIFYKPHEYGQYIGPGQKIYTVKDSESLKDLNRTKLSWEWRSNHTNPRTNKTYVEGDMFLHSRFIGASLDVKCLAFVPSLIAFVWFGFFIWFFGRFLKNEPRMENQDKTYTRMKRKSPSEHSKDMGITRENTQASVEDPLNDPSLVCIRSDFNEIVYKSSHLTSENLSSQLNESTSATEADQDPTTSKSTPTN

SEQ ID NO: 3036 - protein, 165 aa, Homo sapiens [sequence omitted]

SEQ ID NO: 3037 - protein, 539 aa, Homo sapiens
MRRGPWERWSLASHRLDAGLCTCPREESREIRAGQIVLKAMAQGLVTFRDVAIEFSLEEWKCLEPAQRDLYREVTLENFGHLASLGLSISKPDVVSLLEQGKEPWMIANDVTGPWCPDLESRCEKFLQKDIFEIGAFNWEIMESLKCSDLEGSDFRADWECEGQFERQVNEECYFKQVNVTYGHMPVFQHHTSHTVRQSRETGEKLMECHECGKAFSRGSHLIQHQKIHTGEKPFGCKECGKAFSRASHLVQHQRIHTGEKPYDCKDCGKAFGRTSELILHQRLHTGVKPYECKECGKTFRQHSQLILHQRTHTGEKPYVCKDCGKAFIRGSQLTVHRRIHTGARPYECKECGKAFRQHSQLTVHQRIHTGEKPYECKECGKGFIHSSEVTRHQRIHSGEKPYECKECGKAFRQHAQLTRHQRVHTGDRPYECKDCGKAFSRSSYLIQHQRIHTGDKPYECKECGKAFIRVSQLTHHQRIHTCEKPYECRECGMAFIRSSQLTEHQRIHPGIKPYECRECGQAFILGSQLIEHYRIHTG

SEQ ID NO: 3038 - protein, 105 aa, Homo sapiens
MNTLEGPWGLCKGSLGSMERDPGVSTEQVPHRPLGQVTALPTQGGICGCSFAVRAKGRHSCPLEECGTQLQSGPWGADHEPQKTLCTIYAEKTTSSAPPALARTK

SEQ ID NO: 3039 - protein, 367 aa, Homo sapiens
MGWRRGRGAPRFPDGMAAGQRRSSLSRLGSQAEGLLTSQTMGGQAETLLTSQTGWLLGRGCNLGSPGGHVSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQAGKILLYYKARTKDILIRFTAWCCILGLISVALTKVSENEGFIPVNKNLWSLSYVTTLSSFAFFILLVLYPVVDVKGLWTGTPFFYPGMNSILVYVGHEVFENYFPFQWKLKDNQSHKEHLTQNIVATALWVLIAYILYRKKIFWKI

SEQ ID NO: 3040 - protein, 766 aa, Homo sapiens
MEEIKPASASCVSKEKPSKVSDLISRFEGGSSLSNYSDLKKESAVNLNAPRTPGRHGLTTTPQQKLLSQHLPQRQGNDADKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFSNISSINAFHSKFLLPELEKRMQEWETTPRIGDILQKLAPFLKMYGEYVKGFDNAMELVKNMTERIPQFKSVVEEIQKQKICGSLTLQHHMLEPVQRIPRYEMLLKDYLRKLPPDSLDWNDAKKSLEIISTAASHSNSAIRKMENLKKLLEIYEMLGEEEDIVNPSNELIKEGQILKLAARNTSAQERYLFLFNNMLLYCVPKFSLVGSKFTVRTRVGIDGMKIVETQNEEYPHTFQVSGKERTLELQASSAQDKEEWIKALQETIDAFHQRHETFRNAIAKDNDIHSEVSTAELGKRAPRWIRDNEVTMCMKCKEPFNALTRRRHHCRACGYVVCWKCSDYKAQLEYDGGKLSKVCKDCYQIISGFTDSEEKKRKGILEIESAEVSGNSVVCSFLQYMEKSKPWQKAWCVIPKQDPLVLYMYGAPQDVRAQATIPLLGYVVDEMPRSADLPHSFKLTQSKSVHSFAADSEELKQKWLKVILLAVTGETPGGPNEHPATLDDHPEPKKKSEC

SEQ ID NO: 3041 - protein, 316 aa, Homo sapiens
MSLGIMEEEDLAEYFRLQYGERLLQMLQKLPNVEGASESLSIWLLEKKKETEIMHQTMVQKKKMFQRRMETLNLRWEELGVKEAQLKAHIQKSEQFIQENDQKRIRAMKKANKERELKCQHMQELTKRKQEMVALRLEHQRLSAKLKDYYIFNKYLEKVVENSEFEEIHEVIARYKTLVSMRHDLMQSAQEGQEKIERAKARLARYMEEKDDEILQQNNELARLQMRFDRARSNVIFWESRWAHIQNTAAKKTLLLGTIKMATLNLFQIVSKHLKEVTEVALEDTHKQLDMIQQFIQDRSDIWAEVKKKEQQRVRI

SEQ ID NO: 3042 - protein, 604 aa, Homo sapiens
MAGDVEGFCSSIHDTSVSAGFRALYEEGLLLDVTLVIEDHQFQAHKALLATQSDYFRIMFTADMRERDQDKIHLKGLTATGFSHVLQFMYYGTIELSMNTVHEILQAAMYVQLIEVVKFCCSFLLAKICLENCAEIMRLLDDFGVNIEGVREKLDTFLLDNFVPLMSRPDFLSYLSFEKLMSYLDNDHLSRFPEIELYEAVQSWLRHDRRRWRHTDTIIQNIRFCLMTPTSVFEKVKTSEFYRYSRQLRYEVDQALNYFQNVHQQPLLDMKSSRIRSAKPQTTVFRGMIGHSMVNSEILLLKKPRVWWELEGPQVPLRPDCLAIVNNFVFLLGGEELGPDGEFHASSKVFRYDPRQNSWLQMADMSVPRSEFAVGVIGKFIYAVAGRTRDETFYSTERYDITNDKWEFVDPYPVNKYGHEGTVLNNKLFITGGITSSSTSKQVCVFDPSKEGTIEQRTRRTQVVTNCWENKSKMNYARCFHKMISYNGKLYVFGGVCVILRASFESQGCPSTEVYNPETDQWTILASMPIGRSGHGVTVLDKQIMVLGGLCYNGHYSDSILTFDPDENKWKEDEYPRMPCKLDGLQVCNLHFPDYVLDEVRRCN

SEQ ID NO: 3043 - protein, 647 aa, Homo sapiens
MWRVCARRAQNVAPWAGLEARWTALQEVPGTPRVTSRSGPAPARRNSVTTGYGGVRALCGWTPSSGATPRNRLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQVPPPTPPPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 3044 - protein, 100 aa, Homo sapiens
MFKSTLEFTGFFFFFFLETESHSVTLAGVQWCDLSSLQPLPPGFKQFSCLSLPSSWDYRHALPHPANFCIFSTDSTVLAMLVSNSWTQVIRLPRPPKVLG

SEQ ID NO: 3045 - protein, 847 aa, Homo sapiens
MRYVRRCVPLPGAPARVTDVELKRLKDAFKRTCGLSYYMGQHCFIREVLGDGVPPKVAEVIYCSFGGTSKGLHFNNLIVGLVLLTRGKDEEKAKYIFSLFSSESGNYVIREEMERMLHVVDGKVPDTLRKCFSEGEKVNYEKFRNWLFLNKDAFTFSRWLLSGGVYVTLTDDSDTPTFYQTLAGVTHLEESDIIDLEKRYWLLKAQSRTGRFDLETFGPLVSPPIRPSLSEGLFNAFDENRDNHIDFKEISCGLSACCRGPLAERQKFCFKVFDVDRDGVLSRVELRDMVVALLEVWKDNRTDDIPELHMDLSDIVEGILNAHDTTKMGHLTLEDYQIWSVKNVLANEFLNLLFQVCHIVLGLRPATPEEEGQIIRGWLERESRYGLQAGHNWFIISMQWWQQWKEYVKYDANPVVIEPSSVLNGGKYSFGTAAHPMEQVEDRIGSSLSYVNTTEEKFSDNISTASEASETAGSGFLYSATPGADVCFARQHNTSDNNNQCLLGANGNILLHLNPQKPGAIDNQPLVTQEPVKATSLTLEGGRLKRTPQLIHGRDYEMVPEPVWRALYHWYGANLALPRPVIKNSKTDIPELELFPRYLLFLRQQPATRTQQSNIWVNMGNVPSPNAPLKRVLAYTGCFSRMQTIKEIHEYLSQRLRIKEEDMRLWLYNSENYLTLLDDEDHKLEYLKIQDEQHLVIEVRNKDMSWPEEMSFIANSSKIDRHEVPTEKGATGLSNLGNTCFMNSSIQCVSNTQPLTQYFISGRHLYELNRTNPIGMKGHMAKCYGDLVQELWSGTQKNVAPLKLRWTIAKYAPRFNGFQQQDSQELLAFLLDGLHEDLNRVHEKPYV

SEQ ID NO: 3046 - protein, 576 aa, Homo sapiens
MASNNHWFQSSQVPSFAQMLKKNLPVQPATKTITTPTGWSSESYGLSKMASKVTQVTGNFPEPLLSKNLSSISNPVLPPKKIPKEFIMKYKRGEINPVSALHQFAQMQRVQLDLKETVTTGNVMGPYFAFCAVVDGIQYKTGLGQNKKESRSNAAKLALDELLQLDEPEPRILETSGPPPFPAEPVVLSELAYVSKVHYEGRHIQYAKISQIVKERFNQLISNRSEYLKYSSSLAAFIIERAGQHEVVAIGTGEYNYSQDIKPDGRVLHDTHAVVTARRSLLRYFYRQLLLFYSKNPAMMEKSIFCTEPTSNLLTLKQNINICLYMNQLPKGSAQIKSQLRLNPHSISAFEANEELCLHVAVEGKIYLTVYCPKDGVNRISSMSSSDKLTRWEVLGVQGALLSHFIQPVYISSILIGDGNCSDTRGLEIAIKQRVDDALTSKLPMFYLVNRPHISLVPSAYPLQMNLEYKFLSLNWAQGDVSLEIVDGLSGKITESSPFKSGMSMASRLCKAAMLSRFNLLAKEAKKELLEAGTYHAAKCMSASYQEAKCKLKSYLQQHGYGSWIVKSPCIEQFNM

SEQ ID NO: 3047 - protein, 141 aa, Homo sapiens
MYVLYPGAVISSLVSQSLVKVFLCMNNCSNGSFFAETSAGKSYFAILLMSLPSMVHLKQKSRHVSAQNPPAAPFYSEQVKVYHGLQDPTWFSSPNSLISSFVYSLFTLSQAHWLLLTNTRHFRVFALVSCLRVFALAVSSA

SEQ ID NO: 3048 - protein, 399 aa, Homo sapiens
MQLKKETIEEKKDRMREKTKLLKEKNEKERQDFVAEKLDQQFRERCEELRVELLSIHQKKVCEERKAQIAFNEELSRQKLVEEQMFSKLWEEDRLAKEKREAQEARRQKELMENTRLGLNAQITSIKAQRQATQLLKEEEARLVESNNAQIKHENEQDMLKKQKAKQETRTILQKALQERIEHIQQEYRDEQDLNMKLVQRALQDLQEEADKKKQKREDMIREQKIYHKYLAQRREEEKAQEKEFDRILEEDKAKKLAEKDKELRLEKEARRQLVDEVMCTRKLQVQEKLQREAKEQEERAMEQKHINESLKELNCEEKENFARRQRLAQEYRKQLQMQIAYQQQSQEAEKEEKRREFEAGVAANKMCLDKVQEVLSTHQVLPQNIHPMRKACPSKLPP

SEQ ID NO: 3049 - protein, 361 aa, Homo sapiens [sequence omitted]

SEQ ID NO: 3050 - protein, 665 aa, Homo sapiens
MEPRVVKPPGQDLVVESLKSRYGLGGSCPDEYDFSNFYQSKYKRRTLTSPGDLDIYSGDKVGSSLKYSDESKHCRTPLGSLFKHVNVNCLDDELDSFHDLKKQETEEELIENDYRVSTSKITKQSFKEIEKVALPTNTTSSRPRTECCSDAGDSPLKPVSCPKSKASDKRSLLPHQISQIYDELFQIHLKLQCETAAQQKFAEELQKRERFLLEREQLLFRHENALSKIKGVEEEVLTRFQIIKEQHDAEVEHLTEVLKEKNKETKRLRSSFDALKELNDTLKKQLNEASEENRKIDIQAKRVQARLDNLQRKYEFMTIQRLKGSSHAVHEMKSLKQEKAPVSKTYKVPLNGQVYELLTVFMDWISDHHLSKVKHEESGMDGKKPQLKFASQRNDIQEKCVKLLPLMTEQLQWMPFVNIKLHEPFVKFIYWSLRQLDAGAQHSTMTSTLRRLGEDIFKGVVTKGIQDNSPQHSVENKPKTAAFFKSSNLPLRFLSTLIVLKTVTQADYLAQAFDSLCLDLKTEEGKTLFLEYQAVPVILSHLRISSKGLLSNVIDSLLQMTVESKSLQPFLEACSNSLFFRTCSVLLRAPKLDLQILEKLSIILQKLSKIKSNKKLFELFTIHLMLQEIQRTTNPEHAFLCINLNSTLFNLGLTKCNSLVSSASP

SEQ ID NO: 3051 - protein, 240 aa, Homo sapiens
MQQRIVELISRVSNEEVTEELLHVNDDLNNVFLRYERFERYRSGRSVQNASNGVLNEVTEDNLIDLGPGSPAVVSPMVGNTAPPSSLSSQLAGLDLGTESVSGTLSSLQQCNPRDGFDMFAQTRGNSLAEQRKTVTYEDPQAVGGLASALDNRKQSSEGIPVAQPSVMDDIEVWLRTDLKGDDLEEGVTSEEFDKFLEERAKAAEMVPDLPSPPMEAPAPASNPSGRKKPERSEDALFAL

SEQ ID NO: 3052 - protein, 308 aa, Homo sapiens [sequence omitted]

SEQ ID NO: 3053 - protein, 103 aa, Homo sapiens
MPCDWTDLVPARLINEKSRWKPRQDETGWMWMGCTSPHIPECPWQLWPRLFSRMPAWRAAWGCDWFLPLGQREDVSRVLRMPSPLGAEQHSTNHSTPPWQACK

SEQ ID NO: 3054 - protein, 117 aa, Homo sapiens
MEKEEFTQSQLGGRPGVLLLLKIMLCPAPHPRRLVPCSGSPRLPSPLAPSWIQPTGDTSRRWKPGRRGWDLSPPLSACLRASRTAASTGQPPLDPKGGNSFLLLPAAGCLNILCWFP

SEQ ID NO: 3055 - protein, 1021 aa, Homo sapiens
MEKVLGCELLKGLNVLDLGLNMEILEEQMLHEILCREYPELETRWQDLKIRALDTCKAVEAAEERLLTMLLFQNPKRQKPAKFLRNIVRAQGKLCQLRAHCEELEGQKLQEMVLWAPYRPVVWHGMAMVKALSQLQNLLPLFCMSPENWLAVTKQALDSMKPREINHGEDLASHLLQLRAHLTRQLLGSTVTALGLTQVPLVGALGALALLQATGKASELERLALWPGLAASPSTVHSKPVSDVARPAWLGPKAWHECEMLELLPPFVGLCASLAGHSSAWQAYLSLSSTVLGPAPGPGPEPLSLLQKLILWRVLRPECLAGALADFTTSLLGRPLDENTYAPTMPFKHSQATQPMLILLPPPGHPSATLHPLTVIQKLAAKYQQGQKQLQVIALGSEAWDPVSVVVSTLSQAMYEGHWLVLDNCHLMPHWPKELLQLLLELLGRAKVVADLESEQLLDQPESRNVSTVHRDFRLWLIVPAESSASLPAVLTQHSMPVFWNQSLELGHVLIDSVELAQQVLYMQPPTQALPLLLLHGLLLHRQLYGTRLQAHRGRWSQVTLTQVLQTQDQLWASLSNPRAAMQELAASVFYGGPLGDTEDREALISLTQACLSPSSGSWVQPHTPQSLLATLMPLPELRELDAMAECKAQMHLLPSPPEPRLCGLSEGPQAWLLRRQSRALLSALQRSSPVWVPESRRGAQLAERRLRQRLVQVNRRLESLQDLLTHVIRQDESDAPWSVLGPNARRPLEGVLETEALELSQLVGTLQRDLDCLLQQLKGAPPCPSRRCAAVAHALWTGRLPLPWRPHAPAGPQPPWHWLRQLSRRGQLLVRYLGVGADASSDVPERVFHLSAFRHPRRLLLALRGEAALDQNVPSSNFPGSRGSVSSQLQYKRLEMNSNPLHFRVENGPNPTVPERGLLLIGLQVLHAEWDPIAGALQDSPSSQPSPLPPVSISTQAPGTSDLPAPADLTVYSCPVYMGGPLGTAKLQSRNIVMHLPLPTKLTPNTCVQRRVHVCSPPLS

SEQ ID NO: 3056 - protein, 119 aa, Homo sapiens [sequence omitted]

SEQ ID NO: 3057 - protein, 310 aa, Homo sapiens
MPPKIPLLRRTPRELFPLLIPHVALVLSQDLELSKPHKCPQGGRLIPFAQGIFRNWLYFVPLLLLVPLLLCCVWRLCRKQTVKEPPPAQKPEKEPEQEKPPSPPPPPPPPPPPLPPPPPAPVNTCPTVIICCCGCQGMGGMRRIEGNLDTFCDLSHASCHQVPWMCCQSRDQGRYLSLALAQSQYAQAPCCPRICFPHSQECLSLPQAPCSPRMCLRHSRECLALKQARCSPNICLRHSPEYFSQAQTLCNPKSCLQPSRECLPLTCSSRCRLPPARCLRPPSRMLPLLPPLLRHTAEPPLSLPPSEPNF

SEQ ID NO: 3058 - protein, 177 aa, Homo sapiens
MSHSRRAAPTQDQCHTPGFPTSRETSGSIWQARICGSLQALDTWRTHIPRKSPAPTQASQICLLLPESPWRNPTPRGFLKPLINWDAILYFKEKRNIQVTTQAHPQNQASCSSQEVATPGLVPQAAAPKVYERSHDNLNAEAQGLAGAQVSKPQNPITRLCSLKEQSILKIFTKQSI

SEQ ID NO: 3059 - protein, 111 aa, Homo sapiens
MTCVSPCSISDTQAHGMTTQAEMSHVSQRSPSVFPGIVGTSTPSPTWTWHPLYSCQFYTNHRKKVELVQAGFSEITCRHATDVYNPQKRKETWKPSLSVTFFLMIVSAMKF

SEQ ID NO: 3060 - protein, 268 aa, Homo sapiens
MRPCPCDRKDKLQHTESSKQQCPCDGEDRLRHTESSKQQCPCDGEDRLRHTESSKQQCPCDGEDRLRHTESSKQQCPCDGEDRLRHTESSKQQCPCDGEDRLRHTESSKHPCPCDGEDRLRHAEGSRLRGSEAGGKRCVCGPRAAGNAEAGSQEGSVSPSRPCRHLQARSPNPACETAGIHCFKPIRLESFVLAAPKASHSSALSTGSVSAGKVGRPHRGTAAGPCKTQGGRASMSEGRRQMPQGITSCMLHLDGKTQKPLPTAGSAD

SEQ ID NO: 3061 - protein, 392 aa, Homo sapiens [sequence omitted]

SEQ ID NO: 3062 - protein, 267 aa, Homo sapiens
MKPVKHLLTTSNKSANVPALTTKKGLHNLPLSPELKEKHNAKLIHDKIEPMVLRSPPTGESILRYALPIPSSKTKNLLPEDEMIGKIIKHLKMVVSTLEETYGHCDQNGEEPFVKHEHEELSLSVGDDMNSFLTYCSQFAAQLEEALKEEQNILESLFKWFQWQVNQMEEISKDQTLLQAEPPKPDKTVILNIAEIVRLVQRFEELKNRLKQRSKSSVKVMLSKTMDKENRPEAVKSCEALAQKIEEFLEAHSTDEFKDVSATEPQL

SEQ ID NO: 3063 - protein, 626 aa, Homo sapiens [sequence omitted]

SEQ ID NO: 3064 - protein, 606 aa, Homo sapiens
MAGSDAEWVTIANNLLFKCHIHLRIHELQDCDANVFIALYQSILGEKVPDLIVIPRSQEDDAHNVQAVIDSLALDYLQVSLSHITGENIVKGDKESIKNLLEIFDGLLEYLTERISETSHEKSETEQYFKESDRGERLEEPESTKESKSSWKRVSFGRCSLSSEMLGPSWDGDEAESTGEIIRLGDTAHTFSLRSNGAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETEKIYRGEAVRKGTPECSQPWKIYSRKTTTQSLRGGLPKPNKAVPMKVSEHSLLPLMLEQFPFLYVSGPTLSKMWKQQIAQVEQLKKEACRENR

SEQ ID NO: 3065 - protein, 721 aa, Homo sapiens
MWNYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEISFGGIPAPGKSVSFPHRNFHGCLENLYYNGVDIIDLAKQQKPQIIAMGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEW

SEQ ID NO: 3066 - protein, 124 aa, Homo sapiens
MSPSSEGSREVRPVGQPIGGVSAIAQVRSGSPRGAGWGPRADLSLLAPLSSNVQNVGGPLFISHAWALASSGVTVEGCPKLVFQSVLSCLKLSCVCVLFVRVCESTSVCAGCVSPFLSSLQTHH

SEQ ID NO: 3067 - protein, 415 aa, Homo sapiens
MSVITAPPCSSCFHSAHRVPSTAPGAWDLSVNKKDRSPARLYRGEGLGQAGSLKYKEATAAGPKECPGGGGSARGTPMRSTSVRAAGGRPVFPPSEEHAFCANLGPVQSSSSSEGLARAQGLSSEASVESNEDSDHACKSSARKQAKSYMKTKNPDSQWPPRAATDREGFLAESSPQTQRAPYSGPQDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPADSKGWQASLQAMSLPELSGALEDRVREMGQALCLVTQSLEKLQVLNGKKWRET

SEQ ID NO: 3068 - protein, 446 aa, Homo sapiens
MVTFEDVAVHFTKTEWTGLSPAQRALYRSVMLENFGNLTALGYPVPKPALISLLERGDMAWGLEAQDDPPAERTKNVCKDVETNIDSESTLIQGISEERDGMMSHGQLKSVPQRTDFPETRNVEKHQDIPTVKNIQGKVPRIPCARKPFICEECGKSFSYFSYYARHQRIHTGEKPFECSECGKAFNGNSSLIRHQRIHTGERPYHCEECGRAFNDNANLIRHQRIHSGDRPYYCTECGNSFTSSSEFVIHQRIHTGEKPYECNECGKAFVGNSPLLRHQKIHTGEKPYECNECGKSFGRTSHLSQHQRIHTGEKPYSCKVCGQAFNFHTKLTRHQRIHSEEKPFDCVDCGKAFSAQEQLKRHLRIHTQESSYVCDECGKALTSKRNLHQHQRIHTGEKPYECSKYEKAFGTSSQLGHLEHVYSGEKPVLDICRFGLPEFFTPFYW

SEQ ID NO: 3069 - protein, 137 aa, Homo sapiens
MSQVGRVRSSHHFESVCLDAEVRVVLVALDHAGLHTLSSALNESLRPIHREELHLLHFPNSPEENLRKRPAEPSPQIHGGAPHLPWLCVEKSDLLPENHAVFLQERTAQLFEGSFFFSRSPAHSISPLLQFRWGHCP

SEQ ID NO: 3070 - protein, 425 aa, Homo sapiens
MMGKLPLGVVSPYVKMSSGGYTDPLKFYATSYCTAYGREDFKPRVGSHVGTGYKSNFQPVVSCQASLEALDNPARGEQAQDHFQSVASQSYRPLEVPDGKHPLPWSMRQTSSGYGREKPSAGPPTKEVRKVHFDTQEHGPQAITGLEPREVPLLRQQQGQDPLERENFRHGPRFMTSEYNSKYLRDPLDQPDFLQKKSIGAKEGSGFTKQSHQSPIVFQPPSQALPGDPALLPGQSVTKSDFLPKTHLHGDEFLPVLARGSKRETAFSRGNERILNPRVPPPCPEPSSVSHQQFQPLHRMQQTNVALLGRETVGKKEPTGFSLNNPMYVRSPCDPDRDQRYLTTYNQGYFENIPKGLDQEGWTRGGIQPQMPGGYALSQPVSCMEATPNPMESLRHLHPHVGRTLTSADPFYQNTPHSSRCVAHS

SEQ ID NO: 3071 - protein, 113 aa, Homo sapiens [sequence omitted]

SEQ ID NO: 3072 - protein, 418 aa, Homo sapiens
MNVCKDSPRNKVNQKSKVMEKKLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLGLVVPCWF

SEQ ID NO: 3073 - protein, 112 aa, Homo sapiens
MKHFFFPEAKALSISSHVESVYVYVHVFRHVNACNHHLKYHKSSLSPFLSACLSTICLFKFFLNKKGISLCLFVGIFYIHLLFTSFVFLRCLQQILAGCTVCVINKTAVKIL

SEQ ID NO: 3074 - protein, 104 aa, Homo sapiens
MRTPVPAVATPASLGAVSRPPQTRSPWAPGGLCSFSASRDGGRHSPILTNQNLARQKRRRPRKCVITLTGEPIHSLDFSLGLVEDPTSWCFPPNSREEKGTLAR

SEQ ID NO: 3075 - protein, 366 aa, Homo sapiens
MASRTVIIDHGSGFLKAGTAGWNEPQMVFPNIVNYLPCKENPGPSYARRRVSLGIDICHPDTFSYPIERGRILNWEGVQYLWSFVLENHRREQEVPPVIITETPLREPADRKKMLEILFELLHVPSVLLADQLQMSLYASGLLTGVVVDSGYGLTRVQPFHQGRPLPASGKTLEFAGQDLSAYLLKSLFKEDCDRRCLFQLETVAVTQMNKCYVPQNLGEALDFRERQQSALDESNTYQLPDGSRVELTPMQRVAPEMFFSPQVFEQPGPSIPRAIVESVESCEISLRPLLVSHVMACGGNTLYPGFTKRLFRELMGDHVSSTKATVWEGSNRNFSVWLGASVVAHLSTYQSEWMSREEYGEHMRM

SEQ ID NO: 3076 - protein, 434 aa, Homo sapiens
MSTQRLRNEDYHDYSSTDVSPEESPSEGLNNLSSPGSYQRFGQSNSTTWFQTLIHLLKGNIGTGLLGLPLAAKNAGIVMGPISLLIIGIVAVHCMGILVKCAHHFCRRLNKSFVDYGDTVMYGLESSPCSWLRNHAHWGRRVVDFFLIVTQLGFCCVYFVFLADNFKQVIEAANGTTNNCHNNETVILTPTMDSRLYMLSFLPFLVLLVFIRNLRALSIFSLLANITMLVSLVMIYQFIVQRIPDPSHLPLVAPWKTYPLFFGTAIFSFEGIGMVLPLENKMKDPRKFPLILYLGMVIVTILYISLGCLGYLQFGANIQGSITLNLPNCWLYQSVKLLYSIGIFFTYALQFYVPAEIISLVGSVSSSALALIIPPLLEVTTFYSEGMSPLTIFKDALISILGFVGFVVGTYEALYELIRPSNAPIFINSTCAFI

SEQ ID NO: 3077 - protein, 488 aa, Homo sapiens
MFSALKYHAIDYLYENVVRKKFYRDALLLRIPSCLYQDESYHVAVTDNKFRRPWTRVSAVSVPGMTDTSVLDQWKASFFVEDFLEKKTITRMVTQINCEFEEVVPSSNPDSQIEVEEVSLYTHMDYNEVFTPVSCLEKCSALQNQNQDLFIDDKGILFVSSRKHLPTLPTLLSRLKLFLVKDPLLDFKGQIFTEANFSRECFSLQETLEAFVKEDFCMDKVNFCQEKLEDTICLNEPSSFLIEYEFLIPPSLKPEIDIPSLSELKELLNPVPEIINYVDEKEKLFERDLTNKHGIEDIGDIKFSSTEILTIQSQSEPEECSKPGELEMPLTPLFLTCQHSSVNSLRTELQTFPLSPVCKINLLTAEESANEYYMMWQLERCRSPLNPFLLTVPRIQEPHSQYSVTDLKKIFSVKEESLVINLEKAEWWKQAGLNLKMMETLEHLNTYLCHDNLSSNDTKIEIFLPTKVLQLECKYITVNISYVNIFRM

SEQ ID NO: 3078 - protein, 873 aa, Homo sapiens
MTDSDEDALKVDQGPSRDIPKPWVIPAPKGILQHIFGTSHVFQSICDVKPKVTGLTVPLKVREYYSRGQQCLEQADWETAVLLFSRALHLDPQLVDFYALRAEAYLQLCDFSSAAQNLRRAYSLQQDNCKHLERLTFVLYLQGQCLFEQCAFLDALNVFSHAAELQPEKPCFRYRCMACLLALKQHQACLTLITNELKQDTTNADVYIFRARLYNFLQKPHLCYRDLHSALLLNPKHPQARMLLQKMVAQAQQARQDAGILAVQGKLQHALQRINRAIENNPLDPSLFLFRGTMYRRLQEFDGAVEDFLKVLDMVTEDQEDMVRQAQRQLLLTYNDFAVHCYRQGAYQEGVLLLNKALRDEQQEKGLYINRGDCFFQLGNLAFAEADYQQALALSPQDEGANTRMGLLQEKMGFCEQRRKQFQKAENHFSTAIRHNPQKAQYYLYRAKSRQLLQNIFGARQDVATVLLLNPKQPKLSLLMTNLFPGMSVEEVLSTQIAHLARLQLEQMVEGSLQAGSPQGIVGMLKRHELERQKALALQHSWKQGEPLIATSEELKATPEIPQVKPGSSEGEAEAPEEEEEKEKEKKEEKKSELIPSKVASLSDSYLDQTSSASSMSFRTTGTSETEMSAICQEYRSTSATAVTFSDSSLLKTQSSDSGNNREALSHGPRKIKATQGQRQSLSKTEPTQSQRRNSSKTKATIHKRNSSKTKATQSQRRNSSKTRATQGQGQSSSKTEATQGQRQSSSEIEATQGPRQEPSKTKTTRSPRQRPRKVKAARGRSWRPSKVDATQGRSRGLLRSSTKTEAFYDSNWSLSKTEYAQGQGQRSSKAEGAQGKSQGMSSTSSKAESTWGPSPSLSKTEVDQDLTYYEAV

SEQ ID NO: 3079 - protein, 589 aa, Homo sapiens [sequence omitted]

SEQ ID NO: 3080 - protein, 192 aa, Homo sapiens
MYNIKQSTDTKEAAAIEARRNREKERQNRFFNVRNRVMGVDVQALNNQVGDRKRREAAERSKEAAYGTSQVQYDVVVQMLEKEEADRTRQLAKKVQEFREQKQQLKNGREFSLWDPGQVWKGLPTYLSYSNTYPGPASLQYFSGEDLDRDTRLRMQQGQFRYNLERQQQEQQQAKVDENYTGKQPGPPDSET

SEQ ID NO: 3081 - protein, 424 aa, Homo sapiens
MLHSQESGSSVFYHSQDDGPGLEGGDCAKNSGAPFILGQAKNARLASGDSTTKHDLNLSQRRRAYSTNQITNHKPLPRATMASDPMPAAKRYPLRKARLQDLTNQTSLDVQRWQIDLQPLLNSGQDLNQGPKLRGPGARRPSLLPQGCQPFLPWGQETQAWSPVRERTSDSRSPGDLEPSHHPSAFETETSSDWDPPAESQERASPSRPATPAPVLGKALVKGLHDSQRLQWEVSFELGTPGPERGGAQDADLWSETFHHLAARAIIRDFEQLAEREGEIEQGSNRRYQVSALHTSKACNIISKYTAFVPVDVSKSRYLPTVVEYPNSGAALRMLGSRALAQQWRGTSSGFGRPQTMLGEDSAPGNGPRKCSQTLMGFKTKTETEHSVRGWKPRGALQNQSVLSTSWSHWPPKPRRTSSTPEPS

SEQ ID NO: 3082 - protein, 706 aa, Homo sapiens
MDIKHHQNGTRGQRRKQPHTTVQRLLTWGLPVSCSWFLWRQPGEFPVTALLLGAGAGGLLAIGLFQLLVNPMNIYEEQKIMFLYSLVGLGAMGWGTSPHIRCASLLLVPKMLGKEGRLFVLGYALAAIYVGPVANLRHNLNNVIASLGCTVELQINNTRAAWRISTAPLRAMFKDLLSSKELLRAETRNISATFEDLDAQVNSETGYTPEDTMDSGETAQGREARQAPASRLHLSTQKMYELKTKLRCSYVVNQAILSCRRWFDRKHEQCMKHIWVPLLTHLLCLPMKFKFFCGIAKVMEVWCRNRIPVEGNFGQTYDSLNQSIRGLDGEFSANIDFKEEKQAGVLGLNTSWERVSTEVRDYVYRQEARLEWALGLLHVLLSCTFLLVLHASFSYMDSYNHDIRFDNIYISTYFCQIDDRRKKLGKRTLLPLRKAEEKTVIFPCKPTIQASEMSNVVRELLETLPIPLLLVVLCGLDWALYSIFDTIRHHSFLQYSFRSSHKLEVKVGGDSLLARLLRKTIGALNTSSETVMESNNMPCLPQPVGLDARAYWRAAVPIGLLVCLCLLQAFGYRLRRVIAAFYFPKREKKRILFLYNDLLKKRAAFTKLRRAAILRRERQQKAPRHPLADILHRGCPLLRRWLCRRCVVCQAPETPESYVCRTLDCEAVYCWSCWDDMRQRCPVCTPREELSSSAFSDSNDDTAYAG

SEQ ID NO: 3083 - protein, 825 aa, Homo sapiens
MATSERALLRTRAASLLRGLGRSRTGARSLQFRAEKERQPCWSFPMGQKTKGSSNIASSYLLQQLMHRYQELDSDGDEDQGEGEAGSEESSESEMLNLEEEFDGVLREEAVAKALHHLGRSGSGTEQVYLNLTLSGCNLIDVSILCGYVHLQKLDLSANKIEDLSCVSCMPYLLELNASQNNLTTFFNFKPPKNLKKADFSHNQISEICDLSAYHALTKLILDGNEIEEISGLEMCNNLIHLSLANNKITTINGLNKLPIKILCLSNNQIEMITGLEDLKALQNLDLSHNQISSLQGLENHDLLEVINLEDNKIAELREIEYIKNLPILRVLNLLENPIQEKSEYWFFVIFMLLRLTELDQKKIKVEEKVSAVNKYDPPPEVVAAQDHLTHVVNSVMQPQRIFDSTLPSLDAPYPMLILAGPEACGKRELAHRLCRQFSTYFRYGACHTTRPPYFGEGDRVDYHFISQDVFDEMVNMGKFILTFSYGNHKYGLNRDTVEGIARDGLASCIHMEIEGVRSLKYSYFEPRYILVVPMNKEKYEGYLRRKGLFSRAEIEFAVSRVDLYIKINQNFPGYFDEVINADDLDVAYQKLSQLIREYLGLTEEPAKSLATTADVKTSHLKPEAHPTKYISSNMGDFLHSTDRNYLIKFWAKLSAKKTPAERDSIHRQHEAARQALMGRIRPDHTLLFQRGPVPAPLTSGLHYYTTLEELWKSFDLCEDYFKPPFGPYPEKSGKDSLVSMKCSLFRFCPWSKELPFQPPEGSISSHLGSGASDSETEETRKALPIQSFSHEKESHQHRQHSVPVISRPGSNVKPTLPPIPQGRR

SEQ ID NO: 3084 - protein, 217 aa, Homo sapiens
MASQKQMEVVTKGTGFRRRPKTITYTPGTCELFRVMMKESKLTNIQQRHIMDIMKRGDALPLQCSPTSSQRVLPSKQIASPIYLPPILAARPHLRPANMCQANGAYSREQFKPQATRDLEKEKQRLQNIFATGKDMEERKRKAPPARQKAPAPELDRFEELVKEIQERKEFLADMEALGQGKQYRGIILAEISQKLREMEDIDHRRSEELRKGLATT

SEQ ID NO: 3085 - protein, 142 aa, Homo sapiens [sequence omitted]

SEQ ID NO: 3086 - protein, 194 aa, Homo sapiens [sequence omitted]

SEQ ID NO: 3087 - protein, 274 aa, Homo sapiens
MAQKHPGERGLYGAHHSGGASLRTLGPSVDPEIPSFSGLRDSAGTAPNGTRCLTEHSGPKHTQHPNPAHWLDPSHGPPGGPGPPRDAEDPDQSETSSEEESGVDQELSKENETGNQKDGNSFLSIPSACNCQGTPGIPEGPYSEGGNGSSSNFCHHCTSPALGEDELEEEYDDEESLKFPSDFSRVSSGKKPPSRRQRHRFPTKEDTREGGRRDPRSPGRHRLGRKRSQADKRKGLGLWGAEELCPFSFLKSMSGSQKGCSTGWSLIYPSSPNT

SEQ ID NO: 3088 - protein, 226 aa, Homo sapiens [sequence omitted]

SEQ ID NO: 3089 - protein, 404 aa, Homo sapiens
MPPPEEAAAVSAPPPAPAGTLLPGPSKWQRPAGTPVPRIRRLLEASHRGQGDPPSLRPLKPPPPPRQLSVKDTVPRAPSQFPPPLETWKPPPPLPSERQPADRRITPALATPASPPTESQAGPRNQGQTAGRARGGAPPHAGEGEMAQPADSESGLSLLCKITFKSRPSLAPPAASSSLAAKASLGGGGGGGLFAASGAISYAEVLKQGPLPPGAARPLGEVSRGAQEAEGGDGDGEGCSGPPSAPASQARALPPPPYTTFPGSKPKFDWVSAPDGPERHFRFNGAGGGIGAPRRRAAALSGPWGSPPPPPEQIHSAPGPRRPAPALLAPPTFIFPAPTNGEPMRPGPPGLQELPPLPPPTPPPTLQPPALQPTPLPVAPPLTPGLGHKESAWLPPQPLLCPQP

SEQ ID NO: 3090 - protein, 474 aa, Homo sapiens
MSIPTGAPPCLARMPLGRLAGSARSEEGSEAFLEGMVDWELSRLQRQCKVMEGERRAYSKEVHQRINKQLEEIRRLEEVRGDLQVQISAAQNQVKRLRDSQRLENMDRLLKGRAQVQAEIEELQEQTRALDKQIQEWETRIFTHSKNVRSPGFILDQKVKIRRRIRILENQLDRVTCHFDNQLVRNAALREELDLLRIDRNRYLNVDRKLKKEIHHLHHLVSTLILSSTSAYAVREEAKAKMGLLRERAEKEEAQSEMEAQVLQRQILHLEQLHHFLKLKNNDRQPDPDVLEKREKQAGEVAEGVWKTSQERLVLCYEDALNKLSQLMGESDPDLLVQKYLEIEERNFAEFNFINEQNLELEHVQEEIKEMQEALVSARASKDDQHLLQEQQQKVLQQRMDKVHSEAERLEARFQDVRGQLEKLKADIQLLFTKAHCDSSMIDDLLGVKTSMGDRDMGLFLSLTCVSRFLSLCS

SEQ ID NO: 3091 - protein, 594 aa, Homo sapiens
MNADFLLPYYTAQSGSSMSMFNTTMGKLQRQLYKGEYDIFKYAPIFESDFIQITKRGEVIDVHNRVRMVTMGIARTSPILPLPDVMLLARPATGCEEYAGHGQATKRKKRKAAKNLELTRLLPLRFVRISVQDHEKQQLRLKFATGRSCYLQLCPALDTRDDLFAYWEKLIYLLRPPMESNSSTCGIPAEDMMWMPVFQEDRRSLGAVNLQGKGDQDQVSIQSLHMVSEVCGATSAAYAGGEGLQNDFNKPTSVLNASIPKTSTELAEEPATGGIKEAAAAGAAAGAATGTVAGALSVAAANSAPGQVSAAIAGAATIGAGGNKGNMALAGTASMAPNSTKVAVAGAAGKSSEHVSSASMSLSREGSVSLAIAGVVLTSRTAAEADMDAAAGPPVSTRQSKSSLSGQHGRERTQASAEGCKEGRERREKDRALGRSSHRRRTGESRHKTRGDKIAQKSSSRSSFSHRANRDDKKEKGCGNPGSSRHRDSHKGVSHTPISKESRTSHKSGRSLWTTSSGSSKGLGRVSSFLRNVRANLTTKVVGTPHGRDVDVMAKMAERSTNVAIAETAEGGQGLETVGSMTPDIMETVTFEAH

SEQ ID NO: 3092 - protein, 156 aa, Homo sapiens
MYRTLCCVQWRNLPGPGESSDSASRLCFASSNVELTSGPQSPAGLSVRHARVVEMGPPGPPAVHWAETSGKPAAGALPGQLPPAQCSQTSPSGKQSVQQMLCEILGFSLFLFCFVFERKKKIQLTSLFCKWVSFLCIKSWWSLVFTCSCCVILRCY

SEQ ID NO: 3093 - protein, 542 aa, Homo sapiens
MPALSTGSGSDTGLYELLAALPAQLQPHVDSQEDLTFLWDMFGEKSLHSLVKIHEKLHYYEKQGPVPILHGAAALADDLAEELQNKPLNSEIRELLKLLSKPNVKALLSVHDTVAQKNYDPVLPPMPEDIDDEEDSVKIIRLVKNREPLGATIKKDEQTGAIIVARIMRGGAADRSGLIHVGDELREVNGIPVEDKRPEEIIQILAQSQGAITFKIIPGSKEETPSKEGKMFIKALFDYNPNEDKAIPCKEAGLSFKKGDILQIMSQDDATWWQAKHEADANPRAGLIPSKHFQERRLALRRPEILVQPLKVSNRKSSGFRRSFRLSRKDKKTNKSMYECKKSDQYDTADVPTYEEVTPYRRQTNEKYRLVVLVGPVGVGLNELKRKLLISDTQHYGVTVPHTTRARRSQESDGVEYIFISKHLFETDVQNNKFIEYGEYKNNYYGTSIDSVRSVLAKNKVCLLDVQPHTVKHLRTLEFKPYVIFIKPPSIERLRETRKNAKIISSRDDQGAAKPFTEEDFQEMIKSAQIMEINMVIFLTKL

SEQ ID NO: 3094 - protein, 343 aa, Homo sapiens
MPRGQKSKLRAREKRHQARCENQDLGATQATVAEGESPSSAYLLFGDRPQNLPAAETPSIPEALQGAPSTTNAIAPVSCSSNEGASSQDEKSLGSSREAEGWKEDPLNKKVVSLVHFLLQKYETKEPITKGDMIKFVIRKDKCHFNEILKRASEHMELALGVDLKEVDPIRHYYAFFSKLDLTYDETTSDEEKIPKTGLLMIALGVIFLNGNRAPEEAVWEIMNMMGVYADRKHFLYGDPRKVMTKDLVQLKYLEYQQVPNSDPPRYEFLWGPRAHAETSKMKVLEFVAKIHDTVPSAFPSCYEEALRDEEQRTQARAAARAHTAAMANARSRTTSSSFSHAK

SEQ ID NO: 3095 - protein, 508 aa, Homo sapiens
MAGQRTCQRRSSRAGPGKMQEPPKSIEEFLKFQNWDYWPREIHFRDDDKWSCTLKKMKEDSSFVSIYTHLWENVPRIFEALLIMESKLKEYSLILQNHTSEIFKWKSMISETSSYRKLERYGEFLKKYHKKKKIMLSDEMETEKNIEGCSFTGFKANELTQLPRHLDAEQIYLFILKAHNFDERVFKIWKTHFLSEASIALLHDSFWWWFLHKFRPDRENQDCLFDRISESYVTLFMSIPLSRKDAFFQIYPDCLAQAIYATFHEAFPESSYLFNDEFKEDLGNNIFLWCSGLKPQKGFWIHWKLKELSTTTIHGSKKAPAKSVKERIADSQEHISTSIDFNIIKILNNPRAYTLPISKEESRLSRLATKSHYSSTGPEFNRVLFNFGGQSPLILYYLKMHELAGISKAPKKTKIKLTKIFQEPLPAPTYRDVIKEAKRQFARNQKDFRILQAKATKKPHEVKQDFEKFLHKLRSEAEIERECVASLSSSSSSSPSSTDNYNFEEEEY

SEQ ID NO: 3096 - protein, 320 aa, Homo sapiens [sequence omitted]

SEQ ID NO: 3097 - protein, 127 aa, Homo sapiens
MCWISLVFPSSSTLLLPTKLTRMDHSSGLLCLLASEWVWPRSVLARDQRMVGCLFSALLLGLGGCLSSQRSLLPNSFPAFQVASPCTLPFWPRMMSVLLLLAWSCRSYCASSLGSLYLYLSPHNIFM

SEQ ID NO: 3098 - protein, 277 aa, Homo sapiens
MQLEQAQGTRERLAQAECVLEQFGNEDHHKFIRFHSMASRAEMPQARPLEGAFSPISFKPGLHQADIKLTVWKRLFRKVLPAPEPLKLDPATAHPLLELSKGNTVVQCGLLAQRRASQPERFDYSTCVLASRGFSCGRHYWEVVVGSKSDWRLGVIKGTASRKGKLNRSPEHGVWLIGLKEGRVYEAFACPRVPLPVAGHPHRIGLYLHYEQGELTFFDADRPDDLRPLYTFQADFQGKLYPILDTCWHERGSNSLPMVLPPPSGPGPLSPEQPTKL

SEQ ID NO: 3099 - protein, 380 aa, Homo sapiens
MALRHLALLAGLLVGVASKSMENTVTRNSTAVINTQAEGTLSPPGLSSLPVVREWALTHTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSGNSSCRIPLWGFPSLGQSQGALWVCPQTGLPGSGSRPPLPGSPGDPPTRQGQGRIWLVPPALDLSWIWPAPPARPPLIPVTSMLFPVPETWGLQERRTHHDRADPQYLLLLEVQLHPRTDAAGLRQALLSSHRFSGAGSGGPKSQPVRKPRYVRRERPLDRATDPAAFPGEARISNV

SEQ ID NO: 3100 - protein, 183 aa, Homo sapiens
MAGGPPNTKAEMEMSLAEELNHGRQGENQEHLVIAEMMELGSRSRGASQKKQKLEQKAAGSASAKRVWNMTATRPKKMGSQLPKPRMLRESGHGDAHLQEYAGNFQGIRFHYDRNPGTDAVAQTSLEEFNVLEMEVMRRQLYAVNRRLRALEEQGATWRHRETLIIAVLVSASIANLWLWMNQ

SEQ ID NO: 3101 - protein, 440 aa, Homo sapiens
MAVKLGTLLLALALGLAQPASARRKLLVFLLDGFRSDYISDEALESLPGFKEIVSRGVKVDYLTPDFPSLSYPNYYTLMTGRHCEVHQMIGNYMWDPTTNKSFDIGVNKDSLMPLWWNGSEPLWVTLTKAKRKVYMYYWPGCEVEILGVRPTYCLEYKNVPTDINFANAVSDALDSFKSGRADLAAIYHERIDVEGHHYGPASPQRKDALKAVDTVLKYMTKWIQERGLQDRLNVIIFSDHGMTDIFWMDKVIELNKYISLNDLQQVKDRGPVVSLWPAPGKHSEIYNKLSTVEHMTVYEKEAIPSRFYYKKGKFVSPLTLVADEGWFITENREMLPFWMNSTGRREGWQRGWHGYDNELMDMRGIFLAFGPDFKSNFRAAPIRSVDVYNVMCNVVGITPLPNNGSWSRVMCMLKGRASTAPPVWPSHCALALILLFLLA

SEQ ID NO: 3102 - protein, 391 aa, Homo sapiens
MNTTFSPKSPPDIDIDIELWDNKTITSGLKNYLRCLAEPLMTYKLHKDFIIAVKSDDQNYRVEAVHALVHKLPEKNREMLDILIKHLVKVSLHSQQNLMTVSNLGVIFGPTLMRAQEETVAAMMNIKFQNIVVEILIEHYEKVFHTAPDPSIPLPQPQSRSGSRRTRAICLSTGSRKPRGRYTPCLAEPDSDSYSSSPDSTPMGSIESLSSHSSEQNSTTKSASCQPREKSGGIPWIATPSSSNGQKSLGLWTTSPESSSREDATKTDAESDCQSVASVTSPGDISPPIDLVKKEPYGLSGLKRASASSLRSISAAEGNKSYSGSIQSLTSVGSKETPKASPNPDLPPKMCRRLRLDTASSNGYQRPGSVVAAKAQLFENVGSPKPVSSGR

SEQ ID NO: 3103 - protein, 467 aa, Homo sapiens
MNMSQASVSFQDVTVEFTREEWQHLGPVERTLYRDVMLENYSHLISVGYCITKPKVISKLEKGEEPWSLEDEFLNQRYPGYFKVDHIKGIREKQEKPLWQEIFISDADKTLSKEGQKVLEKPFNLEIAPELSEKISCKCDSHRMNLPVASQLIISERKYSRKKTEYMNVCEKLQLDIKHEKAHAEEKSYEHGENAKAFSYKKDQHWKFQTLEESFECDGSGQGLYDKTICITPQSFLTGEKSCKDDEFRKNFDKITLFNHMRTDTRGKCSDLNEYGTSCDKTTAVEYNKVHMAMTHYECNERGINFSRKSPLTQSQRTITGWSAFESNKCEENFSQSSAHIVHQKTQAGDKFGEHNECTDALYQKLDFTAHQRIHTEDKFYLSDEHGKCRKSFYRKAHLIQHQRPHSGEKTYQYEECAKSFCSSSHPIQHPGTYVGFKLYECNECGKAFCQNSNLSKHLRIHKKKKK

SEQ ID NO: 3104 - protein, 124 aa, Homo sapiens
MWPCRLAPTGLEHIPWNLIPGAPGAARTQLHGCPSQWERQERPAPSLTPHSSSWENDAVTLGGETLQMGTSTLGAGVFPEFGGIFHSLRMVSGLSDPSSQAPRHHFTTPCSASPRENSSINYEC

SEQ ID NO: 3105 - protein, 108 aa, Homo sapiens
MHKKEVPPHAPPGIFLGLSHMNPLRLPLRKQRSEDPPSTPHFGKVDIKAQRRDRTSPMTNRVTSDSGAMPRTLSPVYCSFPRTSPQHSSSTCRWKAFDLNVTCLPLSA

SEQ ID NO: 3106 - protein, 294 aa, Homo sapiens [sequence omitted]

SEQ ID NO: 3107 - protein, 541 aa, Homo sapiens
MSTIQSETDCYDIIEVLGKGTFGEVAKGWRRSTGEMVAIKILKNDAYRNRIIKNELKLLHCMRGLDPEEAHVIRFLEFFHDALKFYLVFELLEQNLFEFQKENNFAPLPARHIRTVTLQVLTALARLKELAIIHADLKPENIMLVDQTRCPFRVKVIDFGSASIFSEVRYVKEPYIQSRFYRAPEILLGLPFCEKVDVWSLGCVMAELHLGWPLYPGNNEYDQVRYICETQGLPKPHLLHAACKAHHFFKRMLTWESHERISPSAALRHPFVSMQQLRSAHETTHYYQLSLRSYRLSLRVEGKPPTPVVAAEDGTPYYCLAEEKEAAGMGSVAGSSPFFREEKAPGMQRAIDQLDDLSLQEAGHGLWGEACTNAVSDMMVPLKAAITGHHVPDSGPEPILAFYSSRLAGRHKARKPPAGSKSDSNFSNLIRLSQVSPEDDRPCRGSSWEEGEHLGASAEPLAILQRDEDGPNIDNMTMEAERPDPELFDPSSCPGEWLSEPDCTLESVRGPRAQGLPPRRSHQHGPPRGATSFLQHVTGHH

SEQ ID NO: 3108 - protein, 351 aa, Homo sapiens
MATDVQLAGYPLMSPKAELKLEKKSGRKPRSPRDSGPQKELVIPGIVDFERIRRALRTPKPQTPGTYCFGRLSHHSFFSRHHPHPQHVTHIQDLTGKPVCVVRDFPAPLPESTVFSGCQMGIPTISVPIGDPQSNRNPQLSSEAWKKELKELASRVAFLTKEDELKKKEKEQKEEPLREQGAKYSAETGRLIPASTRAVGRRRSHQGQQSQSSSRHEGVQAFLLQDQELLVLELLCQILETDLLSAIQFWLLYAPPKEKDLALGLLQTAVAQLLPQPLVSIPTEKLLSQLPEVHEPPQEKQEPPCSQSPKKTKISPFTKSEKPEYIGEAQVLQMHSSQNTEKKTSKPRAES

SEQ ID NO: 3109 - protein, 259 aa, Homo sapiens
MADAAATAGAGGSGTRSGSKQSTNPADNYHLARRRTLQVVVSSLLTEAGFESAEKASVETLTEMLQSYISEIGRSAKSYCEHTARTQPTLSDIVVTLVEMGFNVDTLPAYAKRSQRMVITAPPVTNQPVTPKALTAGQDRPHPPHIPSHFPEFPDPHTYIKTPTYREPVSDYQVLREKAASQRRDVERALTRFMAKTGETQSLFKDDVSTFPLIAARPFTIPYLTALLPSELEMQQMEEQIPRSRMNRQTQRTLLFISA

SEQ ID NO: 3110 - protein, 365 aa, Homo sapiens [sequence omitted]

SEQ ID NO: 3111 - protein, 148 aa, Homo sapiens
MALLCAPVRDEAIQKLETIRDPVQLLRGILRVLGLMKMDMVNYTIQSFRPYLQEHSIQSEQAKFQELLDKQPSLLDYTTKWLTKAATDITTLCPSSPDSPSSSCSMACSLPSGADSADGQNPAPGTGIPVAPVNCPGLSLASGQKLLW

SEQ ID NO: 3112 - protein, 192 aa, Homo sapiens
MNVVNVEKPSGAVQSSSGIGESTLERSLMNVENVGRPSAGAQPLFSIRKFTLEIKAMNVLHVVRLLVGVLSLLNIKEFTLERNLMNVMNVENPSIRAQPSPSTREFTLERSLMNVVNVEKHLGIGQALCSIREHTPEFNSVGKSCTIVKCKEFTVGVRLHRKEKFPESRTSVLPSQFGTIRRHAHKDVCYDY

SEQ ID NO: 3113 - protein, 656 aa, Homo sapiens
MFEAIFPSTPQARLKRDPREKPGLSSFRSTFRQQSSLGLCIPCLMLPKEASPSERHSSMSSSMARALVLLQSMASRDARCPEWKPHQKPRTLSKSVQTISRYYRKTSEPKDAASLTGFMSKMELRRVFPTHPDCPQFSTRATSMSHCGSPTEADLSGEIDNSSETWRGTQDLFLARRGSDTNVDGYLLPFSKSICEFDYLRKRRKSQTLSPVTSSSVASQSCLRKRMPWYLSVIHEKDHCLSELEIQVQKKDEEILLLQEEREALKTQLKCLLKGKGQETSMSPGRREQLSDASLKLGRLSLLKAFSRHEEELQHWWQMQEESAAPERGKEPDLGGGEEDEGLEGEPDGVEDTGAWGGVSQMGSVHEEGSEEEEEEEGDKDEDSEERELPEEEEIPRRRASSLAESFEEELLAQLEEYEQVILDFQFNLEATRTRYSLATGVIASLQQQVDFQETQLRKINTENETLQKELRERRQQLQAMTDKFSNLREDKKHQEMMGLIEKDNQLLRQQVSELERKLTKRDCVISELDTKVSQLQEQVELDQNHLQRWKQLQEDLQSKKEMIQQAEQHTRVALESSQSRLERLRNKIIQATFSISGTKSLANEISDNDILEALQRIISERSDYYNQLKQKGVKVPPLQQSEAFLTSKSKKGTSK

SEQ ID NO: 3114 - protein, 669 aa, Homo sapiens
MGKKIKKEVEPPPKDVFDPLMIESKKAATVVLMLNSPEEEILAKACEAIYKFALKGEENKTTLLELGAVEPLTKLLTHEDKIVRRNATMIFGILASNNDVKKLLRELDVMNSVIAQLAPEEEVVIHEFASLCLANMSAEYTSKVQIFEHGGLEPLIRLLSSPDPDVKKNSMECIYNLVQDFQCRAKLQELNAIPPILDLLKSEYPVIQLLALKTLGVIANDKESRTMLRDNQGLDHLIKILETKELNDLHIEALAVIANCLEDMDTMVQIQQTGGLKKLLSFAENSTIPDIQKNAAKAITKAAYDPENRKLFHEQEVEKCLVALLGSENDGTKIAASQAISAMCENSGSKDFFNNQGIPQLIQLLKSDNEEVREAAALALANLTTCNPANANAAAEADGIDPLINLLSSKRDGAIANAATVLTNMAMQEPLRLNIQNHDIMHAIISPLRSANTVVQSKAALAVTATACDVEARTELRNSGGLEPLVELLRSKNDEVRKHASWAVMVCAGDELTANELCRLGALDILEEVNVSGTRKNKFSEAAYNKLLNNNLSLKYSQTGYLSSSNIINDGFYDYGRINPGTKLLSLKELCLQEPSDLRAVLLINSKSYVSPPSSMEDKSDVGYGRSISSSSSLRRSSKEKNNAGFGSPIEDKSEPASGRNTVLSKSAT

SEQ ID NO: 3115 - protein, 490 aa, Homo sapiens
MERVGCTLTTTYAHPRPTPTNFLPAISTMASSYRDRFPHSNLTHSLSLPWRPSTYYKVASNSPSVAPYCTRSQRVSENTMLPFVSNRTTFFTRYTPDDWYRSNLTNYQESNTSRHNSEKLRVDTSRLIQDKYQQTRKTQADTTQNLGERVNDIGFWKSEIIHELDEMIGETNALTDVKKRLERALMETEAPLQVARECLFHREKRMGIDLVHDEVEAQLLTEVDTILCCQERMKLHLDKAIAQLAANRASQHELEKDLSDKQTAYRIDDKCHHLRNTSDGVAYFRGVERVDATVSVPESWAKFTDDNILRSQSERAASAKLRDDIENLLVVTANEMWNQFNKVNLSFTNRIAETADAKNKIQTHLAKTLQEIFQTEMTIESIKKAIKDKTAFLKVAQTRLDERTRRPNIELCRDMAQLRLVNEVHEVDDTIQTLQQRLRDAEDTLQSLVHIKATLEYDLAVKANSLYIDQEKCMSMRKSYPNTLRLVGFC

SEQ ID NO: 3116 - protein, 615 aa, Homo sapiens [sequence omitted]

SEQ ID NO: 3117 - protein, 570 aa, Homo sapiens
MAYEKSTDISDVSRSMFLYPWLEYPDKTKELRKAMAPVHLPLSCYQMPKEEFPPSPECWRQHPSKPNSVPYCYFKKPEIYTHWHDLYDQREEREAEKMLRKMRDDCRYIKEVHQTHIKMFHLPMSKLTIKSEMRSRPLEPTQDPLKWQRLRELTKSLESPREDEQFYAAQALGCLRISDKFVMEALQQVAQTGPEKVKYEAYRTLAILGCLNKHVIRALIKRLKEKNEGQRMETLTGLRMALNSWAAVSKDKRTQVGDEGKLVPVLQTLIKKSSSEASLEAALCLGFLRPCSNMVQEFLLQCLCQGLKTQRMKALRMLVKVMHVHSAPVIKAILDQLCSSSVLEDRFEATQMLKTIGLEQIQAQGLEELTFNLLRRKTHNEPFLAVRQAVAQTVEELKLKPTMMNLVEAQLMNPDATARQEAVISLGVLGIRSPQVFHLLLDLLDAENHQAVKKSLQETLILCASIDPWIQNKLKNKVLFVYEAPKTNVKAEPTRFQKEPENPEELTIQDFRLAKLNPLFIAKSITKVGQKKTPAFPPCCSKPRKHRPQVIGPWQPRIKKQLRVLAEIAK

SEQ ID NO: 3118 - protein, 178 aa, Homo sapiens
MNKRTSVDASKEDLHPADPQSGEGVPPNRKNTKTSPRGEGTAPPFSARPCVWTLCEMLSILALVGVLHPFYRSNNQVYQKLKTHLRCQSSRVDGLMLKPTLLTPSQLKSPEGHLILPTFNHLVIRHILDPKQIFCVADVCTDCKFNCGSIERHQKRHLMRVSQDWEHLIRYRNQICLS

SEQ ID NO: 3119 - protein, 602 aa, Homo sapiens
MAAERRCGSMRDLRAQVTSGLLPFPEVTLQALGEDEITLESVLRGKFAAGKNGLACLACGPQLEVVNSITGERLSAYRFSGVNEQPPVVLAVKEFSWQKRTGLLIGLEETEGSVLCLYDLGISKVVKAVVLPGRVTAIEPIINHGGASASTQHLHPSLRWLFGVAAVVTDVGQILLIDLCLDDLSCNQNEVEASDLEVLTGIPAEVPHIRESVMREGRHLCFQLVSPTGTAVSTLSYISRTNQLAAGFSDGYLALWNMKSMKREYYIQLESGQVPVYAVTFQEPENDRRNCCYLWAVQSTQDSEGDVLSLHLLQLAFGNRKCLASGQILYEWLEYCEERYTLDLTGGMFPLRGQTSNTKLLGCQSIEKFRSHGDREEGVNEALSPDTSVSVFTWQVNIYGQGKPSVYLGLFDINRWYHAQMPDSLRSGEYLHNCSYFALWSLESVVSRTSPHGILDILVHERSLNRGVPPSYPPPEQFFNPSTYNFDATCLLNSGVVHLTCTGFQKETLTFLKKSGPSLNELIPGGYNRRLVAGLLSPSFVDVQPSSLSQEEQLEAILSTAIQTSSLGLLTGYIRRWITEEQPNSATNLRFVLEWTWNKVVL

SEQ ID NO: 3120 - protein, 123 aa, Homo sapiens
MVVSADPLSSERAEMNILEINQELRSQLAESNQQFRDLKEKFLITQATAYSLANQLKKYKCEEYRNHLPPERCRRLKKRKSLRTHWRNVLSLVQIVTTLLTPTSLTGAPKSHLRNTKSTLLWL

SEQ ID NO: 3121 - protein, 142 aa, Homo sapiens
MDGGSLRASPAAMDGGALEPAQQLSSLEGWTGQDRLLIPRWREARSLSWMQSPDLESSKCLTQGRCYPQAWILACSAALLQALASSDLQGSLDRVNYSRGLGPRVRLFVFPDTVGSTRKSGSTGNICSVMLNVATGCVRIEK

SEQ ID NO: 3122 - protein, 142 aa, Homo sapiens
MSDLFVFSSKLEGTPNLFVSRVPDGVVLGVEEPEGKAQGRVRGELCPGALARIHMGHSCTRLSAEGIAMLLGTAGPSRLPAAPDASQAPLRSPWALSVAAALCSPVSCHPCGRHVVTFGHCPAQGPWGLGTFGHSFFGCLCK

SEQ ID NO: 3123 - protein, 120 aa, Homo sapiens
MWYRAGTMALCDSSRQRLPWQACSGACHIDRCPQVHLAPSHRQGPLCIGTVSPPRDPTTARTPSRGASGPSPRRSRCSQWPRTACPQAWPGTSWQWGSRRRSRGCASASPAWEDRAAAEE

SEQ ID NO: 3124 - protein, 647 aa, Homo sapiens
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQPQLGDRVAPFTLGPSLKRCLGPEQRTRLPVVGDGGDVDSGRLLFWGPSRGRASPSTGQPPCHPVCRPSSPPSPRPSSGDPSRVKAGHKHVGTGRANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 3125 - protein, 224 aa, Homo sapiens
MEPSDMPAGYHCPLDSAPWDETRDPQSTELIPRRAISRSPTCARCRNHGVTAHLKGHKRLCLFQACECHKCVHILERRRVMAAQVALRRQQEAQLKKHLMRRGEASPKAPNHFRKGTTQPQVPSGKENIAPQPQTPHGAVLLAPTPPGKPCTQLQPVPSAPAELLWASAAQPSPGSLALVLDSGASWPLGPWTLAASRLLHATTSGVPPAVPRTCCLSASLPWL

SEQ ID NO: 3126 - protein, 539 aa, Homo sapiens [sequence omitted]

SEQ ID NO: 3127 - protein, 367 aa, Homo sapiens
MENLESRLKNAPYFRCEKGTDSIPLCRKCETRVLAWKIFSTKEWFCRINDISQRRLLVGILKQLNSLYLLHYFQNILQTTQGKDFIYNRSRIDLSKKEGKVVKSSLNQMLDKTVEQKMKEILYWFANSTQWTKANYTLLLLQMCNPKLLLTAANVIRVLFLREENNISGLNQDITDVCFSPEKDHSSKSATSQVYWTAKTQHTSLPLSKAPENEHFLGAASNPEEPWRNSLRCISEMNRLFSGKGDITKPGYDPCNLLVDVDDIRDLSSGFSKYRDFIRYLPIHLSKYILRMLDRHTLNKCASVSQHWAAMAQQVKMDLSAHGFIQNQITFLQGSYTREMFSVGPTMFAFSLTRGIKTESSTIPGEI

SEQ ID NO: 3128 - protein, 121 aa, Homo sapiens [sequence omitted]

SEQ ID NO: 3129 - protein, 778 aa, Homo sapiens
MEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKDTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRVRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLE

SEQ ID NO: 3130 - protein, 123 aa, Homo sapiens [sequence omitted]

SEQ ID NO: 3131 - protein, 466 aa, Homo sapiens
MELGRSIPDTQLEQVIESQKANQCAVLIYTSGTTGIPKGVMLSHDNITWIAGAVTKDFKLTDKHETVVSYLPLSHIAAQMMDIWVPIKIGALTYFAQADALKGTLVSTLKEVKPTVFIGVPQIWEKIHEMVKKNSAKSMGLKKKAFVWARNIGFKVNSKKMLGKYNTPVSYRMAKTLVFSKVKTSLGLDHCHSFISGTAPLNQETAEFFLSLDIPIGELYGLSESSGPHTISNQNNYRLLSCGKILTGCKNMLFQQNKDGIGEICLWGRHIFMGYLESETETTEAIDDEGWLHSGDLGQLDGLGFLYVTGHIKEILITAGGENVPPIPVETLVKKKIPIISNAMLVGDKLKFLSMLLTLKCEMNQMSGEPLDKLNFEAINFCRGLGSQASTVTEIVKQQDPLVYKAIQQGINAVNQEAMNNAQRIEKWVILEKDFSIYGGELGPMMKLKRHFVAQKYKKQIDHMYH

SEQ ID NO: 3132 - protein, 306 aa, Homo sapiens [sequence omitted]

SEQ ID NO: 3133 - protein, 754 aa, Homo sapiens [sequence omitted]

SEQ ID NO: 3134 - protein, 157 aa, Homo sapiens
MQPLGFDYHAKRQQISAFSSLQNTWTIQSSISLLFRMKSVYNIRPLTPQYVRLFLVAGNFFRIQKLLMEASVFVIKEGAVCGIARPKTSRVNSSQDQIQVASENTHSGSLHQRPASGARLPASCGQELPLFSQRAVGGLEPRKQSEAHTPASFLPCS

SEQ ID NO: 3135 - protein, 335 aa, Homo sapiens [sequence omitted]

SEQ ID NO: 3136 - protein, 536 aa, Homo sapiens
MEEPPQEALAEPLKHESPAAPSSAGHTKGQEEDDQKNQAERKADNHTAHRIADQTALRVPSQAESSIFSQATNGVAEQNGHSTPGQAGRRASNPADVSDLRADDQVNQTPSEQTKGKASSQANNVQHEQSDGQVSGLTEERTAEQTERRLPTQAERRTSGQIDGRLAMPSDQRGSRQTDHRMAGQSERRASEQMDRRMSGEAERRTSEQITHRLSKLSERRPSVQIDSGSSVPSDQSPSVQIDSGSSVPSDQRPSVQIDRRMSGKVRRRSSEKTDYRLAGLADPGTSEQTDLRLYGLVDHKTSVKTHHQVYGQATELAEHQAIDQAHSNADQPPVDNAHYTESDQTDHLADRQANHKDQLSYYETRGQSEDRIFPQLGNSKEDKEADYRVQPCKFEDSQVDLNSKPSVEMETQNATTIPPYNPVDARFTSNFQAKDQALFPRLPSILSKLNYTSSQEKTQAIVTKSDEFSEIDQGKGYHIRNQTYRRFPSIVYEDPYQVSLQYMEKHHILQIFQQITENLVYEKPEDPLNFMLCQV

SEQ ID NO: 3137 - protein, 106 aa, Homo sapiens
MYAVLYMGHRGILPWKQSNSKECSIQLVNIDGRRRLRIPLAYLKATCNTSPAGANNKTLRSTKVILPSQVKIARKASGTEKNYLYNDRAVYAKTVMDLSMTYQILL

SEQ ID NO: 3138 - protein, 433 aa, Homo sapiens
MTSENQEKVKALLRDLQEQDADAGSERGLSGEEEDDEPDCCNDERYWPAGQEPSLVPDLDPLEYAGLASVEPYVPEFTVSPFAVQKLSRYGFNTERCQAVLRMCDGDVGASLEHLLTQCFSETFGERMKISEAVNQISLDECMEQRQEEAFALKSICGEKFIERIQNRVWTIGLELEYLTSRFRKSKPKESTKNVQENSLEICKFYLKGNCKFGSKCRFKHEVPPNQIVGRIERSVDDSHLNAIEDASFLYELEIRFSKDHKYPYQAPLVAFYSTNENLPLACRLHISEFLYDKALTFAETSEPVVYSLITLLEEESEIVKLLTNTHHKYSDPPVNFLPVPSRTRINNPACHKTVIPNNSFVSNQIPEVEKTSESEESDEDDGPAPVIVENESYVNLKKKISKRYDWQAKSVHAENGKICKQFRMKQVLNSHM

SEQ ID NO: 3139 - protein, 723 aa, Homo sapiens
MAEEEETAALTEKVIRTQRVFINLLDSYSSGNIGKFLSNCVVGASLEEITEEEEEEDENKSAMLEASSTKVKEGTFQIVGTLSKPDSPRPDFAVETYSAISQEDLLMRLLECDVIIYNITESSQQMEEAIWAVSALSEEVSHFEKRKLFILLSTVMTWARSKALDPEDSEVPFTEEDYRRRKSHPNFLDHINAEKMVLKFGKKARKFAAYVVAAGLQYGAEGGMLHTFFKMAWLGEIPALPVFGDGTNVIPTIHVLDLAGVIQNVIDHVPKLHYLVAVDESVHTLEDIVKCISKNTGPGKIQKIPRENAYLTKDLTQDCLDHLLVNLRMEALFVKENFNIRWAAQTGFVENINTILKEYKQSRGLMPIKICILGPPAVGKSSIAKELAKYYKLHHIQLKDVISEAIAKLGAIVAPNDVGEGEEEVEEEEEEENVEDAQELLDGIKESMEQNAGQLDDQYIIRFMKEKLKSMPCRNQGYILDGFPKTYDQAKDLFNQEDEEEEDDVRGRMFPFDKLIIPEFVCALDASDEFLKERVINLPESIVAGTHYSQDRFLRALSNYRDINIDDETVFNYFDELEIHPIHIDVGKLEDAQNRLAIKQLIKEIGEPRNYGLTDEEKAEEERKAAEERLAREAAEEAEREHQEAVEMAEKIARWEEWNKRLEEVKREERELLEAQSIPLRNYLMTYVMPTLIQGLNECCNVRPEDPVDFLAEYLFKNNPEAQ

SEQ ID NO: 3140 - protein, 123 aa, Homo sapiens
MWKPRSPPRGNGRRRPSTRASPARTRSVTATRTSWTTTAASRPGPAAGRARSPASTISACTTRCAPSAGWRAGTSRSRTGFSPAKSDCPSAASSEDAVILHLFVSRSPGSRLSTPTSQCLSHE

SEQ ID NO: 3141 - protein, 452 aa, Homo sapiens
MLQKDHKFLYEVFAQLKDETTHDDRRCELLFFFKELCSFSQALQPQSKDALFETLIQLGVLPALKIVMIRDDLQVRSAAAVICAYLVEYSPSRIREFIISEAHVCKDSDLFINVIIKQMICDTDPELGGAVHLMVVLHTLLDPRNMLTTPEKSERSEFLHFFYKHCMHKFTAPLLAATSEHNCEEDDIAGYDKSKNCPNDNQTAQLLALILELLTFCIQHHTFYIRSYILNKDLLRKALILMNSKHTHLILCVLRFMRRMICLNDEAYNNYIIKGNLFEPVVNALLDNGTRYNMLNSAILELFEYIRVENIKPLVSHIVEKFYNTLESIEYVQTFKGLKIKYEKERDRQSQIQKNLHSVLQNIVVFRGTIEEIGLEEEICFMEDAGEAVMPPLEDDDEFMETKRTQEGEAVMPPLEDDDKFTETKRTHQDEEEKEEDKEDETSPKKKPHLSS

SEQ ID NO: 3142 - protein, 130 aa, Homo sapiens
MMVGDLSLMSPELKMGKPASPGSDLYAYGCLLLWLSVQNQEFEINKDGIPKVDQFHLDDKVKSLLCSLICYRSSMTAEQVLNAECFLMPKEQSVPNPEKDTEYTLYKKEEEIKTENLDKCMEKTRNVSRS

SEQ ID NO: 3143 - protein, 154 aa, Homo sapiens
MGSKCCKGGPDEDAVERQRRQKLLLAQLHHRKRVKAAGQIQAWWRGVLVRRTLLVAALRAWMIQCWWRTLVQRRIRQRRQALLRVYVIQEQATVKLQSCIRMWQCRQCYRQMCNALCLFQVPESSLAFQTDGFLQVQYAIPSKQPEFHIEILSI

SEQ ID NO: 3144 - protein, 485 aa, Homo sapiens
MEFLGTTQTASYCGPKKCCGLTSLPAVQAPVIQECYQPYYLPGYRYLNSWRPSLFYKIANVQTCPDESTSTLRPPTILPTLRSALFSRYSPHDWDQSNQLQVRGAEASRLWASRLTDDSMRLLQDKDQLTHQMQEGTCRNLGQRLSDIGFWKSELSYELDRLLTENQNLETVKRRLECAANEVNCPLQVALECLYHREKRIGIDLVHDNVEKNLIREVDLLKCCQEQMRKLAQRIDIQMRDNRDAQHVLERDLEDKSSAQCIDEKCFNLRNTSDCISFFHGMEKIDGTISVPETWAKFSNDNIKHSQNMRANSIQLREEAEHLFETLSDQMWRQFTDTNLAFNARISEVTDVKNKLQTQLAKTLQEIFQAENTIMLLERSIMAKEGPLKVAQTRLECRTRRPNMELCRDIPQLKLVNEVFTIDDTLQTLKLRLRETQDTLQLLVMTKCRLEHELAIKANTLCIDKEKCMGMRKTFPCTPRLVGHT

SEQ ID NO: 3145 - protein, 170 aa, Homo sapiens
MHIHTCVYTCTYADMHTYMHTCAHAYTCKHACTHVHTPHRHALTRTDTPKHAHTHVHIYAHMQICTHANANMHAHMYTHHTDTDMHSHTHAHTQTWTYTCTHTHTHAVTHVHMHAGTQTRTYTTLHKHAHTDTNTCAHTCTCTHTTHRHAHTRAHRHAHTRTQRHTFTNT

SEQ ID NO: 3146 - protein, 196 aa, Homo sapiens
MADSAQAQKLVYLVTGGCGFLGEHVVRMLLQREPRLGELRVFDQHLGPWLEELKTGPVRVTAIQGDVTQAHEVAAAVAGAHVVIHTAGLVDVFGRASPKTIHEVNVQGTRNVIEACVQTGTRFLVYTSSMEVVGPNTKGHPFYRGNEDTPYEAVHRHPYPCSKALAEWLVLEANGRKAMLPGCTCWQPGSWSSGQP

SEQ ID NO: 3147 - protein, 445 aa, Homo sapiens
MMEESGIETTPPGTPPPNPAGLAATAMSSTPVPLAATSSFSSPNVSSMESFPPLAYSTPQPPLPPVRPSAPLPFVPPPAVPSVPPLVTSMPPPVSPSTAAAFGNPPVSHFPPSTSAPNTLLPAPPSGPPISGFSVGSTYDITRGHAGRAPQTPLMPSFSAPSGTGLLPTPITQQASLTSLAQGTGTTSAITFPEEQEDPRITRGQDEASAGGIWGFIKGVAGNPMVKSVLDKTKHSVESMITTLDPGMAPYIKSGGELDIVVTSNKEVKVAAVRDAFQEVFGLAVVVGEAGQSNIAPQPVGYAAGLKGAQERIDSLRRTGVIHEKQTAVSVENFIAELLPDKWFDIGCLVVEDPVHGIHLETFTQATPVPLEFVQQAQSLTPQDYNLRWSGLLVTVGEVLEKSLLNVSRTDWHMAFTGMSRRQMIYSAARAIAGMYKQRLPPRTV

SEQ ID NO: 3148 - protein, 119 aa, Homo sapiens
MKASLLHLLSSQHLILPILVSKWSPHVVQAGLKLLGSSDSPALASQSAGITGVSYRTRPLPLSYQFASVHVWLLCHFFHLLDHWDFSCRWQEAPSPSVSTDKDRHHPAHNPSAPLISVT

SEQ ID NO: 3149 - protein, 556 aa, Homo sapiens
MGQDTDMLNTYQQLVRTPSVRPGQDVRLQAPGTRTGLLKLLSTVSQDKQGCLGSGDGVPNQDLQQRPQSSRQTAKKDRKPRGQSKKGQGSEESEDHFPLLPRKPSFPFQWAWESIATDVRAVLQPSSPTPGHQALPMPSSFSQRQSRRKSTANLPEAHGCCWKTEAQNLKARQQLGAWGGVSIPTGKGELGSEPPSGLQLPGRRPGSGSASDKQVQLQSLGAEEAERGLSSGVLPQRPRRGSISEEEQFSEATEEAEEGEHRTPCRRRAGCQRKGQISGEEASDEGEVQGQSQGSSPSFNNLRRRQWRKTRAKELQGPWDLEKLHRQLQRDLDCGPQKLPWKTLRAAFQASKRNGKAYASGYDETFVSANLPNRTFHKRQEATRSLLQAWERQRQEERQQAELRRARTQHVQRQVAHCLAAYAPRGSRGPGAAQRKLEELRRQERQRFAEYQAELQGIQHRVQARPFLFQQAMQANARLTVTRRFSQVLSALGLDEEQLLSEAGKVDREGTPRKPRSHRSMGVRMEHSPQRPPRTEPTGSQPDRHYNPSLDPECSP

SEQ ID NO: 3150 - protein, 602 aa, Homo sapiens
MSQTSLKQKKNEPGMRSSKESLEAEKRKESDKTGVRLSNQMRRAVNPNHSLRCCPFQGHSSCRRCLCAAEGTALGPCHTIRIYIHMCLLWEQGQQITMMRGSQESSLRKTDSRGYLVRSQWSRISRSPSTKAPSIDEPRSRNTSAKLPSSSTSSRTPSTSPSLHDSSPPPLSGQPSLQPPASPQLPRSLDSRPPTPPEPDPGSRRSTKMQENPEAWAQGIVREIRQTRDSQPLEYSRTSPTEWKSSSQRRGIYPASTQLDRNSLSEQQQQQREDEDDYEAAYWASMRSFYEKNPSCSRPWPPKPKNAITIALSSCALFNMVDGRKIYEQEGLEKYMEYQLTNENVILTPGPAFRFVKALQYVNARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQGPLKGFLEDLGRLQKKFYAKNERLLCPIRTYLVTARSAASSGARVLKTLRRWGLEIDEALFLAGAPKSPILVKIRPHIFFDDHMFHIEGAQRKSLGWMS

SEQ ID NO: 3151 - protein, 354 aa, Homo sapiens
MALDSTIAHLSLRNNNIDDRGAQLLGQALSTLHSCNRTLVSLNLGFNHIGDEGAGYIADGLRLNRSLLWLSLAHNRIQDKGALKLAEVLRAFELTHTEVVERRRLLLEKGTQERSRSPSSSRHGDSKTDREKSQMVGISNSALVDKTDKTQTMKTPKGLGKKKEKSWELAKKEEKLGSGQSPTQGTPKKEDATKAGKGKVTIPEQKPSRAKGIKIGSREKRSILLESEQLVVEATEVVNPLLEPVEHRDGKVFMPGNKVLLHLNLIRNRITEVGLEGFLATVQYQMQFSKAKSASKGPVGLLWLSLAVSPFHSLLLKQTLPLSAVILDSCCRQLLSPHFQGRKIASPHNVLRTP

SEQ ID NO: 3152 - protein, 102 aa, Homo sapiens
MWSQERRGIQRAWETLGENNQLVSTSQRDSQSGSSQRPKLAHSTLLTLKTLQLLLHGMCESTERWRHGCLEIVLKGTTGKREVEIKTRVAATGDEARVKEVG

SEQ ID NO: 3153 - protein, 188 aa, Homo sapiens [sequence omitted]

SEQ ID NO: 3154 - protein, 566 aa, Homo sapiens
MDIQLDPARDDLPLMANTSHILVKHYVLDLDVDFESQVIEGTIVLFLEDGNRFKKQNSSIEEACQSESNKACKFGMPEPCHIPVTNARTFSSEMEYNDFAICSKGEKDTSDKDGNHDNQEHASGISSSKYCCDTGNHGSEDFLLVLDCCDLSVLKVEEVDVAAVPGLEKFTRSPELTVVSEEFRNQIVRELVTLPANRWREQLDYYARCSQAPGCGELLFDTDTWSLQIRKTGAQTATDFPHAIRIWYKTKPEGRSVTWTSDQSGRPCVYTVGSPINNRALFPCQEPPVAMSTWQATVRAAASFVVLMSGENSAKPTQLWEECSSWYYYVTMPMPASTFTIAVGCWTEMKMETWSSNDLATERPFSPSEANFRHVGVCSHMEYPCRFQNASATTQEIIPHRVFAPVCLTGACQETLLRLIPPCLSAAHSVLGAHPFSRLDVLIVPANFPSLGMASPHIMFLSQSILTGGNHLCGTRLCHEIAHAWFGLAIGARDWTEEWLSEGFATHLEDVFWATAQQLAPYEAREQQELRACLRWRRLQDEMQCSPEEMQVLRFPHVGGCSGSFS

SEQ ID NO: 3155 - protein, 296 aa, Homo sapiens
MASMMVQVWFACYNGFTGQPLYEGWFLALFNLLYSTLPVLYIGLFEQDVSAEQSLEKPELYVVGQKDELFNYWVFVQAIAHGVTTSLVNFFMTLWISRDTAGPASFSDHQSFAVVVALSCLLSITMEVILIIKYWTALCVATILLSLGFYAIMTTTTQSFWLFRVSPTTFPFLYADLSVMSSPSILLVVLLSVSINTFPVLALRVIFPALKELRAKEEKVEEGPSEEIFTMEPLPHVHRESRARRSSYAFSHREGYANLITQGTILRRGPGVSSDIASESLDPSDEEAASSPKESQ

SEQ ID NO: 3156 - protein, 274 aa, Homo sapiens [sequence omitted]

SEQ ID NO: 3157 - protein, 572 aa, Homo sapiens
MRRHMVTYAWQLLKKELGLYQLAMDIIIMIRVCKMFRQGLRGFREYQIIETAHWKHPIFSFWDKKMQSRVTFDTMDFIAEEGHFPPKAIQIMQKKPSWRTEDEIQAVCNILQVLDSYRNYAEPLQLLLAKVMRFERFGRRRVIIKKGQKGNSFYFIYLGTVAITKDEDGSSAFLDPHPKLLHKGSCFGEMDVLHASVRRSTIVCMEETEFLVVDREDFFANKLDQEVQKDAQYRFEFFRKMELFASWSDEKLWQLVAMAKIERFSYGQLISKDFGESPFIMFISKGSCEVLRLLDLGASPSYRRWIWQHLELIDGRPLKTHLSEYSPMERFKEFQIKSYPLQDFSSLKLPHLKKAWGLQGTSFSRKIRTSGDTLSKMLGPKIQSRPAQSIKCAMINIKPGELPKEAAVGAYVKVHTVEQGEILAFLPEGECDTRPLILMSLGNELIRIRKEIFYELIDNDDEMIKKLLKLNIAFPSDEDMCQKFLQQNSWNIFRKDLLQLLVEPCQSQLFTPNRPKKREIYNPKSVVLDLCSINKTTKPRYPIFMAPQKYLPPLRIVQAIKAPRYKIRELLA

SEQ ID NO: 3158 - protein, 166 aa, Homo sapiens
MLPFFSNTTSKSVSVSSFQGSPATPLSFLFFFFLCRAGSSMTGCFTFFLDFIFFFAGVLGPSPMGMYSGASTLTGFFLLRFLGQLSMDLEGLEWLGRASPSWWIFFSSSPSHRVPWGSCASASAPRLPVPHPPSPLSKCPQHPRPRRTKGPGLRKLWGPGPPFFPS

SEQ ID NO: 3159 - protein, 140 aa, Homo sapiens
MKARAPGAMKLRRRRDTGTERGSRVRQRGWSQLTTHPVLGSGSPRLIAPRRPWTLSHVAPRTCWSNPAGVLPAELCWALVKSSGYMAPRPPSHPPLALCHRCRCHHLPHHKTTVPIGPLTLLTPCFLSSPWSILAATEGN

SEQ ID NO: 3160 - protein, 395 aa, Homo sapiens [sequence omitted]

SEQ ID NO: 3161 - protein, 706 aa, Homo sapiens
MALPSPQVLMGLPALLMGPAQHTSWPCGSAVPTLKSMVTFEDVAVYFSQEEWELLDAAQRHLYHSVMLENLELVTSLGSWHGVEGEGAHPKQNVSVEVLQVRIPNADPSTKKANSCDMCGPFLKDILHLAEHQGTQSEEKPYTCGACGRDFWLNANLHQHQKEHSGGKPFRWYKDRDALMKSSKVHLSENPFTCREGGKVILGSCDLLQLQAVDSGQKPYSNLGQLPEVCTTQKLFECSNCGKAFLKSSTLPNHLRTHSEEIPFTCPTGGNFLEEKSILGNKKFHTGEISHVCKECGKAFSHSSKLRKHQKFHTEVKYYECIACGKTFNHKLTFVHHQRIHSGERPYECDECGKAFSNRSHLIRHEKVHTGERPFECLKCGRAFSQSSNFLRHQKVHTQVRPYECSQCGKSFSRSSALIQHWRVHTGERPYECSECGRAFNNNSNLAQHQKVHTGERPFECSECGRDFSQSSHLLRHQKVHTGERPFECCDCGKAFSNSSTLIQHQKVHTGQRPYECSECRKSFSRSSSLIQHWRIHTGEKPYECSECGKAFAHSSTLIEHWRVHTKERPYECNECGKFFSQNSILIKHQKVHTGEKPYKCSECGKFFSRKSSLICHWRVHTGERPYECSECGRAFSSNSHLVRHQRVHTQERPYECIQCGKAFSERSTLVRHQKVHTRERTYECSQCGKLFSHLCNLAQHKKIHT

SEQ ID NO: 3162 - protein, 273 aa, Homo sapiens
MPLGAGTPVNVQRREDSATEGSHRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLSTAKGDVICYYGNRGEPDPIVLTPGTYGLSNALLETPWRKLCFGKQLFLEAVERSQALPKDVLNNEEAQLPDPAIEDQGGEYVQPMLSKYAAVCVRCPGYGTRTNTIILVDADGHVTFTERSMMDKDLSHWETRTYEFTLQS

SEQ ID NO: 3163 - protein, 143 aa, Homo sapiens
MATPLDNCLRPFPDPMVKVTAETKKISEVSSYVSANNKKNSFWGSGLLYPVALLRCQDCWAGHQTHVLSKEFTSYFSSGAGREAQHQPSAVLGSLIWLRRVYLLRAMVVHGGSQPCQRWLVIRMEVGGHPSFPGHAWLTFHLN

SEQ ID NO: 3164 - protein, 334 aa, Homo sapiens
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVEWVNVLNKAIKITVPKQSDSQPNSDNLSRHGECGKKQVSYRTDIVGGVPIITPTQKEEVNECGESIDRNNLKRSQSHLPYFTPKPPQDSAVIKAGYCVKQGAVMKNWKRRYFQLDENTIGYFKSELEKEPLRVIPLKEVHKVQECKQSDIMMRDNLFEIVTTSRTFYVQADSPEEMHSWIKAVSGAIVAQRGPGRSASSMRQARRLSNPCIQRYTSRAGECSTYVGSHANVPS

SEQ ID NO: 3165 - protein, 554 aa, Homo sapiens [sequence omitted]

SEQ ID NO: 3166 - protein, 522 aa, Homo sapiens
MAENLKRLVSNETLRTLQEKLDFWLKEYNTNTCDQNLNHCLELIEQVAKVQGQLFGILTAAAQEGGRNDGVETIKSRLLPWLEASFTAASLGKSVDSKVPSLQDTFDRERHKDPSPRDRDMQQLDSNLNSTRSQCNQVQDDLVETEKNLEESKNRSAISLLAAEEEINQLKKQLKSLQAQEDARHRNTDQRSSENRRSEPWSLEERKREQWNSLKQNADQQDTEAMPDYKKQLRNLKEEIAVLSAEKSALQGRSSRSRSPSPAPRSRSCSRSRSASPSTAVKVRRPSPNRSKLSNVARKAALLSRFSDSYSQARLDAQCLLRRCIDKAETVQRIIYIATVEAFHVAKMAFRHFKIHVRKSLTPSYVGSNDFENAVLDYVICHLDLYDSQSSVNDVIRAMNVNPKISFPPVVDFCLLSDFIQEICCIAFAMQALEPPLDIAYGADGEVFNDCKYRRSYDSDFTAPLVLYHVWPALMENDCVIMKGEAVTRRGAFVRWPCIVTIHPKCLIHKFENIYKPRDSIK

SEQ ID NO: 3167 - protein, 490 aa, Homo sapiens
MADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 3168 - protein, 245 aa, Homo sapiens
MTLVILLVELGGSQARFPLFWRNFPITFACYAALLCLSASIIYPTTYLQFLSHGRSRDHAIAAIVFSGIACVAYATEVTWTRARPGEITDYMASELGLLKVLETFVACLIFVFINSPYVYHNRPALEWCVAVYALCFVLAALTVLLSLGHCTNMLPIRFPSFLLGLALLSVLLYATALVLWPLYQFNEKYGVQPWQTRDVSCSDRNPYLVCIWDRRLAVTNLTAVNLLAYVGDLVYSAHLVFVKV

SEQ ID NO: 3169 - protein, 282 aa, Homo sapiens [sequence omitted]

SEQ ID NO: 3170 - protein, 108 aa, Homo sapiens
MALWTMCMSPGGTKPGPDQQTCLQIPTVQVLAVIGRGGLAPRLLAECFGKGRQTTQAAAEYSISMSSGGRQLQGAWPTHTSLWHKQWWIWSLWHMQVLVSLFPPYNCC

SEQ ID NO: 3171 - protein, 299 aa, Homo sapiens
MEELLPDGQIWANMDPEERMLAAATAFTHICAGQGEGDVRREAQSIQYDPYSKASVAPGKRPALPVQLQYPHVESNVPSETVSEASQRLRKPVMKRKVLRRKPDGEVLVTDESIISESESGTENDQDLWDLRQRLMNVQFQEDKESSFDVSQKFNLPHEYQGISQDQLICSLQREGMGSPAYEQDLIVASRPKSFILPKLDQLSRNRGKTDRVARYFEYKRDWDSIRLPGEDHRKELRWGVREQMLCRAEPQSKPQHIYVPNNYLVPTEKKRSALRWGVRCDLANGVIPRKLPFPLSPS

SEQ ID NO: 3172 - protein, 413 aa, Homo sapiens [sequence omitted]

SEQ ID NO: 3173 - protein, 140 aa, Homo sapiens
MPHARTETSVGTYESHSTSELEDLTEPEQRELKTKLTKLEAEIVTLRHVLAAKERRCGELKRKLGLTALVGLRQNLSKSWLDVQVSNTYVKQKTSAALSTMGTLICRKPGGVKKSATLRSFEGLMGTIKSKVSGGKRAWP

SEQ ID NO: 3174 - protein, 285 aa, Homo sapiens
MPLCSLLTCLGLNVLFLTLNEGAWYSVGALMISVPALLGYLQEVCRARLPDSELMRRKYHSVRQEDLQRVRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTESLSSQDLTPGSVEEAEEAEPDEEFKDAIEEDDEGAPCPAEDELALQDNGFLSKNEVLRSKVSRLTERLRKRYPTNNFGVTGAGSS

SEQ ID NO: 3175 - protein, 416 aa, Homo sapiens [sequence omitted]

SEQ ID NO: 3176 - protein, 317 aa, Homo sapiens [sequence omitted]

SEQ ID NO: 3177 - protein, 109 aa, Homo sapiens [sequence omitted]

SEQ ID NO: 3178 - protein, 100 aa, Homo sapiens [sequence omitted]

SEQ ID NO: 3179 - protein, 274 aa, Homo sapiens
MLQQQPPRLISVQTMQRGNMNCGAFQAHQMRLAQNAARIPGIPRHSGPQYSLMQPHLQRQHSNPGHAGPFPVVSVHNTTINPTSPTTATMANANRGPTSPSVTAIELIPSVTNPENLPSLPDIPPIQLEDAGSSSLDNLLSRYISGSHLPPQPTSTMNPSPGPSALSPGSSGLSNSHTPVRPPSTSSTGSRGSCGSSGRTAEKTSLSFKSDQVKVKQEPGTEDEICSFSGGVKHYLAFQVGTGYAHFVEILESQKLNMIVIICNIVRRGKLRRG

SEQ ID NO: 3180 - protein, 463 aa, Homo sapiens
MEAQVLQRQILHLEQLHHFLKLKNNDRQPDPDVLEKREKQAGEVAEGVWKTSQERLVLCYEDALNKLSQLMGESDPDLLVQKYLEIEERNFAEFNFINEQNLELEHVQEEIKEMQEALVSARASKDDQHLLQEQQQKVLQQRMDKVHSEAERLEARFQDVRGQLEKLKADIQLLFTKAHCDSSMIDDLLGVKTSMGDRDMGLFLSLIEKRLVELLTVQAFLHAQSFTSLADAALLVLGQSLEDLPKKMAPLQPPDTLEDPPGFEASDDYPMSREELLSQVEKLVELQEQAEAQRQKDLAAAAAKLDGTLSVDLASTQRAGSSTVLVPTRHPHAIPGSILSHKTSRDRGSLGHVTFGGLSSSTGHLPSHITHGDPNTGHVTFGSTSASSGGHVTFRPVSASSYLGSTGYVGSSRGGENTEGGVESGGTASDSSGGLGSSRDHVSSTGPASSTGPGSSTSKDSRG

SEQ ID NO: 3181 - protein, 109 aa, Homo sapiens [sequence omitted]

SEQ ID NO: 3182 - protein, 540 aa, Homo sapiens
MNLTEGPLAMAEMDPTQGRVVFEDVAIYFSQEEWGHLDEAQRLLYRDVMLENLALLSSLGSWHGAEDEEAPSQQGFSVGVSEVTTSKPCLSSQKVHPSETCGPPLKDILCLVEHNGIHPEQHIYICEAELFQHPKQQIGENLSRGDDWIPSFGKNHRVHMAEEIFTCMEGWKDLPATSCLLQHQGPQSEWKPYRDTEDREAFQTGQNDYKCSECGKTFTCSYSFVEHQKIHTGERSYECNKCGKFFKYSANFMKHQTVHTSERTYECRECGKSFMYNYRLMRHKRVHTGERPYECNTCGKFFRYSSTFVRHQRVHTGERPYECRECGKFFMDSSTLIKHQRVHTGERPYKCNDCGKFFRYISTLIRHQRIHTGERPYECSVCGELFRYSSSLVKHWRNHTGERPYKCSECGKSFRYHCRLIRHQRVHTGERPYECSECGKFFRYNSNLIKHWRNHTGERPYECRECGKAFSHKHILVEHQKIHSGERPYECSECQKAFIRKSHLVHHQKIHSEERLVCSMNVGNSLAKTPTSLNIRDFTM

SEQ ID NO: 3183 - protein, 519 aa, Homo sapiens
MPGPPGSLEMRPLIFRDVAIEFSLEEWQCLNTAQQNLYRNVMLENYRNLVFLGIAVSKPDLITCLEKEKYPWNMKRHKMVDESPVICSHFAKDLCPEQDRKCYFPEVILRRYDKCEHENLQLRKVCKSVDECKVHKQGYNGLNQHLTTTQSKLHQCNEDGKVFHKFSNLNTHKTRHTGKKPFKCKECGKSFCILSHLTRHKVINIEKKPHKSEECRKACSVSSNLTKCRRIHPGEKPYKCEQCGKAFNSSSHLTQHKIIHTKKKPYGSQECRKAFSVSSTVTQHKRVHTGEKPYKCKECGKSFKRSSHLTAHKRIHTGEKPYKCEECGKSFRKSSHLAAHKRIHTGEKPYQCEECGKAYKCSSALTRHRRIHTGEKPYKCEECGKAYICSSTLNKHKRIHTGEKPYKCEECGKAYKCSSTLSKHKRLHTGEKPYKCEECGKAYKCSSSLTRHKRIHTGEKPYKCEECGKAFYCSSHLTRHKRIHTGEKPYKFEECGKAYNWSSTFAKHEKSCWKETRQT

SEQ ID NO: 3184 - protein, 639 aa, Homo sapiens
MPKVMKDVVHPLGGEEPSMARAVVRSVGGFTLGLSLATAYGLLELLVEGHSPWGCLVGTLTLAAFLSLGMGFSRQVRATVLLLLPQAFSRQGRTLLLVAAFGLVLQGPCANTLRNFTRASEAVACGAELALNQTAEVLQRAKQPLVSALNKIKAIARKTKEVADRVRKFFRSIMDGVKHIARALRNVWQWLLHIGDVCNSELGNPYLKCARVFDDAKDSCMMVIPQAYHLCYVLMPFKLALCGLASLVQVFCVIPKYIQPFLRQTIGTPVIQLLNRVRQEFEFNMTATHHFSVDLNASRSLSQVAMDLHEAVSMKLHRVREALALMGFTTPLLLVLLYLQALFYRYCYLNWDHYDNIYITSRFLRMEAVRSTAGLPTVLPLSAHEARRYIPPGSIFLSQWEKFFYILETFNLIRHLLLVLFLVFLDYAVFWVLDLARHQLQGEIVARSPVLVSLTVEGTGYAGNIYRDLVSAFDVLQQGNISILSRRCLLRPSEPDSTGYIVIGVMYGLCFFITLFGSYVSRLRRVICASYYPSREQERISYLYNVLLSRRTNLLAALHRSVRRRAADQGHRSAFLVLASRCPCLGPFVSHFWLHQAYCLGCGQPQDEGDMENTVSCSTPGCQGFICKWHCSSSLVCTP

SEQ ID NO: 3185 - protein, 662 aa, Homo sapiens
MLKLSGEGLRDSYHSRRDQIALKNLQSDVTEAKSDFTKETLASQNTKMISSIVISQMIDENKSRENRASLPLPCAIAQSRAHHAKQSLANRSGVNIHRAFALLPGRLGIPAPSDERGPEAELPPKEERPCGGPRRGFASITITARRVGPPARALVWGTAGDSLCPKCRAEDTLFQAPPALANGAHPGRHQRSFACTEFSRNSSVVRLKVPEAHTGLCERRKYWVTHADDKETSFSPDTPLSGKSPLVFSSCVHLRVSQQCPDSIYYVDKSLSVPIEPPQIASPKMHRSVLSLNLNCSSHRLTADGVDGLVNREPISEALKQELLEGDQDLVGQRWNPGLQESHLKETPSLRRVHLGTGACPWSGSFPLENTELANVGANQVTVRKGEKDHTTHCHASDHANQLSIHIPGWSYRAVHTKVFSGSSKRQQGEVCMTVSAPPVEQKPTRHFLPIGDSSPSDDCLSRDLSEPTERRHQSFLKPRILFPGFLCPLQDVCASLQEDNGVQIESKFPKGDYTCCDLVVKIKECKKSEDPTTPEPSPAAPSPAPRDGAGSPGLSEDCSESQQTPARSLTLQEALEVRKPQFISRSQERLKKLEHMVQQRKAQRKEDLRQKQSLLPIRTSKKQFTIPHPLSDNLFKPKERCISEKEMHMRSKGIYDNLPEV

SEQ ID NO: 3186 - protein, 248 aa, Homo sapiens
MAPKAAKGAKPEPAPAPPPPGAKPEEDKKDGKEPSDKPQKAVQDHKEPSDKPQKAVQPKHEVGTRRGCRRYRWELKDSNKEFWLLGHAEIKIRSLGCLIAAMILLSSLTVHPILRLIITMEISFFSFFILLYSFAIHRYIPFILWPISDLFNDLIAYAFLVGAVVFAVRSRRSMNLHYLLAVILIGAAGVFAFIDVCLQRNHFRGKKAKKHMLVPPPGKEKGPQQGKGPEPAKPPEPGKPPGPAKGKK

SEQ ID NO: 3187 - protein, 443 aa, Homo sapiens
MKPNKRVEVAQLNDVMDTMLERAGVENQEYTGPTKMHKLLHILKKEQTIYNMIFHELIRQVSVDCADRGELLSKVRERYVQMLDQIARQMIDFYKDLVTQRVMDQRILEELYNFKHVIEELTRELCLVRAHDVKLTKETEKAHKDLAQALLNAEKNAKIVEEYHDLYTLQRERMENDMKKLVAERDIWSSATYELALKVIERNRVILARRLYLNEKGWNKYTKHFIILLSNKDTEDLALLQKLTQKWRNLVNKLKQEVEQMEESTSETLKIVKDGLIKWQEFFNEKDILSPNKGNIFNSVLLDFKQWQKILNEKKEEFTGDVLLSKYDTLKIIKHLQENWADIGLGIFNRHKSLEGEMPSERQYMEEIIKNIQKLYKEYEIRINGDNETGSHRVAQAGLKLLGSSDHPTSAPQSAGIRGIIHRTWPWVNFYIVCEVTPKFFQV

SEQ ID NO: 3188 - protein, 167 aa, Homo sapiens
MEETYTDSLDPEKLLQCPYDKNHQIRACRFPYHLIKCRKNHPDVASKLATCPFNARHQVPRAEISHHISSCDDRSCIEQDVVNQTRSLRQETLAESTWQCPPCDEDWDKDLWEQTSTPFVWGTTHYSDNNSPASNIVTEHKNNLASGMRVPKSLPYVLPWKNNGNAQ

SEQ ID NO: 3189 - protein, 171 aa, Homo sapiens [sequence omitted]

SEQ ID NO: 3190 - protein, 544 aa, Homo sapiens
MRESQPEAEIPLQDTTAEAFTMLLKYIYTGRATLTDEKEEVLLDFLSLAHKYGFPELEDSTSEYLCTILNIQNVCMTFDVASLYSLPKLTCMCCMFMDRNAQEVLSSEGFLSLSKTALLNIVLRDSFAAPEKDIFLALLNWCKHNSKENHAEIMQAVRLPLMSLTELLNVVRPSGLLSPDAILDAIKVRSESRDMDLNYRGMLIPEENIATMKYGAQVVKGELKSALLDGDTQNYDLDHGFSRHPIDDDCRSGIEIKLGQPSVINHIRILLWDRDSRSYSYFIEVSMDELDWVRVIDHSQYLCRSWQKLYFPARVCRYIRIVGTHNTVNKIFHIVAFECMFTNKTFTLEKGLIVPMENVATIADCASVIEGVSRSRNALLNGDTKNYDWDSGYTCHQLGSGAIVVQLAQPYMIGSIRLLLWDCDDRSYSYYVEVSTNQQQWTMVADRTKVSCKSWQSVTFERQPASFIRIVGTHNTANEVFHCVHFECPEQQSSQKEENSEESGTGDTSLAGQQLDSHALRAPSGSSLPSSPGSNSRSPNRQHQ

SEQ ID NO: 3191 - protein, 405 aa, Homo sapiens
MDSHKETKDKLKETTTKLTQAKEEADQIRKNCQDMIKTYQESEEIKSNELDAKLRVTKGELEKQMQEKSDQLEMHHAKIKELEDLKRTFKEGMDELRTLRTKVKCLEDERLRTEDELSKYKEIINRQKAEIQNLLDKVKTADQLQEQLQRGKQEIENLKEEVESLNSLINDLQKDIEGSRKRESELLLFTERLTSKNAQLQSESNSLQSQFDKVSCSESQLQSQCEQMKQTNINLESRLLKEEELRKEEVQTLQAELACRQTEVKALSTQVEELKDELVTQRRKHASSIKDLTKQLQQARRKLDQVESGSYDKEVSSMGSRSSSSGSLNARSSAEDRSPENTGSSVAVDNFPQVDKAMLIERIVRLRKAHARKNEKIEFMEDHIKQLVEEIRKKTKKIYKHLEQK

SEQ ID NO: 3192 - protein, 733 aa, Homo sapiens
MFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPELPADTTATVEDMLPSVTTVTTNSDTITETFATAQNSPTRRAP

SEQ ID NO: 3193 - protein, 758 aa, Homo sapiens
MRKQGVSSKRLQSSGRSQSKGRRGASLAREPEVEEEMEKSALGGGKLPRGSWRSSPGRIQSLKERKGLELEVVAKTFLLGPFQFVRNSLAQLREKVQELQARRFSSRTTLGIAVFVAILHWLHLVTLFENDRHFSHLSSLEREMTFRTEMGLYYSYFKTIIEAPSFLEGLWMIMNDRLTEYPLIINAIKRFHLYPEVIIASWYCTFMGIMNLFGLETKTCWNVTRIEPLNEVQSCEGLGDPACFYVGVIFILNGLMMGLFFMYGAYLSGTQLGGLITVLCFFFNHGEATRVMWTPPLRESFSYPFLVLQMCILTLILRTSSNDRRPFIALCLSNVAFMLPWQFAQFILFTQIASLFPMYVVGYIEPSKFQKIIYMNMISVTLSFILMFGNSMYLSSYYSSSLLMTWAIILKRNEIQKLGVSKLNFWLIQGSAWWCGTIILKFLTSKILGVSDHIRLSDLIAARILRYTDFDTLIYTCAPEFDFMEKATPLRYTKTLLLPVVMVITCFIFKKTVRDISYVLATNIYLRKQLLEHSELAFHTLQLLVFTALAILIMRLKMFLTPHMCVMASLICSRQLFGWLFRRVRFEKVIFGILTVMSIQGYANLRNQWSIIGEFNNLPQEELLQWIKYSTTSDAVFAGAMPTMASIKLSTLHPIVNHPHYEDADLRARTKIVYSTYSRKSAKEVRDKLLELHVNYYVLEEAWCVVRTKPGCSMLEIWDVEDPSNAANPPLCSVLLEDARPYFTTVFQNSVYRVLKVN

SEQ ID NO: 3194 - protein, 141 aa, Homo sapiens [sequence omitted]

SEQ ID NO: 3195 - protein, 573 aa, Homo sapiens
MGKCLSCCKEDQSFQRCSPEDQVSTDAQHRGASSISQPSISLGHKTSYSPVTHKVNAAKASRRLLSVSSPSFSERRYSLFVGFQKRNASPYWQQSRANFDSEEDTGFTDIKSSSDHCGSFISRRRRFSSRKLSIVSYYKSAIFFDPQASGQNVFNLNEIEIFSKTSSNTDAKKHITISAPEYNTKNFKNFETNTTSPAFGNTIDTASYQQSTSSFFSLASDISSPDQQNGIANDIQQRGQLCKDLKDFLHPRPESYSTDHSPIMIPQHPSQSGTFPFLHKAGFSSSYKNSGCFIPPQSELTSGLFEDEDFAVLFQDEDRSSPIEIPKIRYITANTDTEEQSFPVPKAFNTRVEELNLDVLLQKVDHLRMSESGKSESFELLRDHKEKFRDEIEFMWRFARAYGDMYELSTNTQEKKHYANIGKTLSERAINRAPMNGHCHLWYAVLCGYVSEFEGLQNKINYGHLFKEHLDIAIKLLPEEPFLYYLKGRYCYTVSKLSWIEKKMAATLFGKIPSSTVQEALHNFLKAEELCPGYSNPNYMYLAKCYTDLEENQNALKFCNLALLLPTVTKEEL

SEQ ID NO: 3196 - protein, 132 aa, Homo sapiens
MKPRPISLVPESLADSCISINLLSQMFSSDLSSYPSFSKSLLATLLASCYTLQSSSSQSPDFFLKVAYYIYISLLLNIPQLFPSGHRIKSSFLACYLGSFSASPHKFLTHLAEAPSFQYSPKCCGTSVYAGF

SEQ ID NO: 3197 - protein, 162 aa, Homo sapiens [sequence omitted]

SEQ ID NO: 3198 - protein, 141 aa, Homo sapiens
MFRTNNLWSVKIQAPVRFEWAVKSRVLLPVSNGSECFCHFLQPSIHLILTTPCPEPGPATATPRETEAVKRLHRLGPTGSLNPCSLSSRGRIVPVSVPATSRRPPSAFLTLLCRQPGASQVPAVIFSSHYSLCLSFHSQAS

SEQ ID NO: 3199 - protein, 940 aa, Homo sapiens [sequence omitted]

SEQ ID NO: 3200 - protein, 173 aa, Homo sapiens
MSTMGNEASYPAEMCSHFDNDEIKRLGRRFKKLDLDKSGSLSVEEFMSLPELRHNPLVRRVIDVFDTDGDGEVDFKEFILGTSQFSVKGDEEQKLRFAFSIYDMDKDGYISNGELFQVLKMMVGNNLTDWQLQQLVDKTIIILDKDGDGKISFEEFSAVVRDLEIHKKLVLIV

SEQ ID NO: 3201 - protein, 109 aa, Homo sapiens
MVEVFIPRKLAGATNQGLFLFQRGSLLTPLDSDGLNCDGGKAGTGDGSRVRRAPDIGREERCQMALTRGSWGTWRLWHRSDGGSLPFQRDRGQGGRNEPWNCPGWWQEG

SEQ ID NO: 3202 - protein, 347 aa, Homo sapiens
MPRGQESKLRAREKRRQARGGLEDLIDALDILEEEEESPPSASACLKDVSQSSLDGASNNPHGLQEARSTSTSATAASHTRHPEGVNDQMEERPICTQDLEATDSFPRGPVDEKVIILVHYLLYKYQMKEPITKADMLRNVTQMSKSQFPVILSRASEHLELILGLDLKEVEPNKHIYVLVNKLDLGCDAKLSDETGVPKTGLLMTVLGIIFTNGNCVAEEEVWKVFNTMGLYDGIEHFMFGEPRKLLTKDLVKENYLEYQQVPNSDPPRYQFLWGPRAHAETSKMKVLEFLAKVNDTAPSEFSNWYTEALQDEEERARARVAAKARVSATAGARSKVKSSKSSQLQ

SEQ ID NO: 3203 - protein, 628 aa, Homo sapiens
MAGLSGAQIPDGEFTALVYRLIRDARYAEAVQLLGQLHPELEQYRLYQAQALYKACLYPEATRVAFLLLDNPAYHSRVLRLQAAIKYSEGDLPGSRSLVEQLLSGEGGEESGGDNETDGQVNLGCLLYKEGQYEAACSKFSATLQASGYQPDLSYNLALAYYSSRQYASALKHIAEIIERGIRQHPELGVGMTTEGFDVRSVGNTLVLHQTALVEAFNLKAAIEYQLRSYEVAQETLTDMPPRAEEELDPVTLHNQALMNMDARPTEGFEKLQFLLQQNPFPPETFGNLLLLYCKYEYFDLAADVLAENAHLTYKFLTPYLYDFLDALITCQTAPEEAFIKLDGLAGMLTEQLRRLTKQVQEARHNRDDEAIKKAVNEYDETMEKYIPVLMAQAKIYWNLENYPMVEKIFRKSVEFCNDHDVWKLNVAHVLFMQENKYKEAIGFYEPIVKKHYDNILNVSAIVLANLCVSYIMTSQNEEAEELMRKIEKEEEQLSYDDPNRKMYHLCIVNLVIGTLYCAKGNYEFGISRVIKSLEPYNKKLGTDTWYYAKRCFLSLLENMSKHMIVIHDSVIQECVQLLGHCELYGTNIPAVIEQPLEEERMHVGKNTVTDESRQLKALIYEIIGWNK

SEQ ID NO: 3204 - protein, 131 aa, Homo sapiens [sequence omitted]

SEQ ID NO: 3205 - protein, 119 aa, Homo sapiens [sequence omitted]

SEQ ID NO: 3206 - protein, 320 aa, Homo sapiens
MTSPPAYKVGDKIATQKTYGLALAKLGRANERVIVLSGDTMNSTFSEIFRKEHPERFIECIIAEQNMVSVALGCATRGRTIAFAGAFAAFFTRAFDQLRMGAISQANINLIGSHCGVSTGEDGVSQMALEDLAMFRSIPNCTVFYPSDAISTEHAIYLAANTKGMCFIRTSQPETAVIYTPQENFEIGQAKVVRHGVNDKVTVIGAGVTLHEALEAADHLSQQGISVRVIDPFTIKPLDAATIISSAKATGGRVITVEDHYREGGIGEAVCAAVSREPDILVHQLAVSGVPQRGKTSELLDMFGISTRHIIAAVTLTLMK

SEQ ID NO: 3207 - protein, 172 aa, Homo sapiens
MCRVEGLIRVPMAQHSRGESRLRTPMVKRAHETGTGPHMPISPDEATVSPGAAHQAPHLCSPQGVERIDEPGLRSLRTARHLQPGMVLTVEPGIYFIDHLLDEALADPARASFLNREVLQRFRGFGGVRIEEDVVVTDSGIELLTCVPRTVEEIEACMAGCDKAFTPFSGPK

SEQ ID NO: 3208 - protein, 504 aa, Homo sapiens
MIQGKEDDIYLMVIWELPDVVPFLQDGKHAVHLRMSTRDRNMAIPFPDVELIVERNFSQPTDNPTMDLLRVNCIDLLQVEGYNLIAAGTLNGVIILWNFVTSTVKKVYRPEDCFTVNPDLHSKHFKINDILFLFRTPECARRSSQDSICSSSQCESSKGPQSSKGSKQSIHDSEVKGEQTDVMVGKQQPMDKKHPGIANLPEAQPPILVTAHEDGHLRLWTLEGRLLKDMLPFTKHSAISLTSLYTDSCTRILLAGNVEGHVILCNISSFLDPPHDEKKFKQLLSWRAHSLEIIQVIYVEEKQVVLTASIDGSVRLWHALNGHYCGYFGQRRLFELSQTRDFILPCDVTEYPIEIKEESKFTEKQKYEYPLIFDREKWRKMSSVSLLFKRTPPKAFEVEQDFKFFKSLSSPKIRRYPLEGFVTENREAGIVFGSLPIYSISSPTSLRFLPLIGVEAQKDSSDGITGKKKGGHVQREKAPRRRSLKKNLVPQINLASSFFPAIPK

SEQ ID NO: 3209 - protein, 605 aa, Homo sapiens
MSNESCLPYYTAHSYSSMSAFKTSMGDLQRQLYNRGEYNIFKYAPMFESNFIQINKKGEVIDVHNRVRMVTVGIVCTSPILPLPDVMVLAQPTKICEQHVRWGRFAKGRGRRPVKTLELTRLLPLKFVKISIHDHEKQQLRLKLATGRTFYLQLCPSSDTREDLFCYWEKLVYLLRPPVESYCSTPTLLSGDAPPEDNKSLVAAELHREGDQSETGLYKPCDVSAATSSAYAGGEGIQHASHGTASAASPSTSTPGAAEGGAARTAGGMAVAGTATGPRTDVAIAGAAMSPATGAMSIATTKSAGPGQVTTALAGAAIKNPGENESSKSMAGAANISSEGISLALVGAASTSLEGTSTSMAGAASLSQDSSLSAAFAGSITTSKCAAERTEGPAVGPLISTLQSEGYMSERDGSQKVSQPSAEVWNENKERREKKDRHPSRKSSHHRKAGESHRRRAGDKNQKASSHRSASGHKNTRDDKKEKGYSNVRGKRHGSSRKSSTHSSTKKESRTTQELGKNQSASSTGALQKKASKISSFLRSLRATPGSKTRVTSHDREVDIVAKTVEKQNIEAKVEKAQGGQELEMISGTMTSEKTEMIVFETKSI

SEQ ID NO: 3210 - protein, 281 aa, Homo sapiens
MTSLTQRSSGLVQRRTEASRNGAGSSEDEQDDDDKGDSKETRLTLMEEVLLLGLKDREGYTSFWNDCISSGLRGCMLIELALRGRLQLEACGMRRKSLLTRKVICKSDAPTGDVLLDEALKHVKETQPPETVQNWIELLSGETWNPLKLHYQLRNVRERLAKNLVEKGVLTTEKQNFLLFDMTTHPLTNNNIKQRLIKKVQEAVLDKWVNDPHRMDRRLLALIYLAHASDVLENAFAPLLDEQYDLATKRVRQLLDLDPEVECLKANTNEVLWAVVAAFTK

SEQ ID NO: 3211 - protein, 130 aa, Homo sapiens
MWQNLAKAETKLHTSNSGGRRELSELVYTDVLDRSCSRNWQDYGVREVDQVKRLTGPGLSEGPEPSISVMVTGGPWPTRLSRTCLHYLGEFGEDQIYEAHQQGRGALEALLCGGPQGACSEKVSATREEL

SEQ ID NO: 3212 - protein, 255 aa, Homo sapiens
MARIRLCPACTPVGRPPVPLHMVSTASGQTRCWTWLSGQACALSIAESCRPGDKVPPIKPNAGEESVTNVDKLRFADGRSIRTSELRLSMQKSTQNHAAVFRVGSLLQEGCGKISKLYGDRKHLKTFDRGMVWNTDLVETLELQNLMLCALQTVNGAEAGKESRGAHTREDYKVQIDEYDHSKPIQGQQKKPFEVHWRKHTLSYVDVGTGKCTARGQHITHKKQLCSCDGGLSTRKEWTVGARSSLNKSESHYAA

SEQ ID NO: 3213 - protein, 100 aa, Homo sapiens [sequence omitted]

SEQ ID NO: 3214 - protein, 163 aa, Homo sapiens
MVFVEPEGGLRGILDCRVDSEPLASLTLHLGSRLVASSQPQGAPAEPHIHVLASPNALRVDIEALRPSDQGEYICSASNVLGSASTSTYFGVRALHRLHQFQQLLWVLGLLVGLLLLLLGLGACYTWSSLILMQPHVRPQPVPHPWADQWCCLPSGGESGQNL

SEQ ID NO: 3215 - protein, 142 aa, Homo sapiens
MELLTASLRLFLSRPAECQDMLGRLLYYCIEEEKDMAVRDRGLFYYRLLLVGIDEVKRILCSPKSDPTLGLLEDPAERPVNSWASDFNTLVPVYGKAHWATISKCQGAERCDPELPKTSSFAASGKNSPYLKSCHDKSLPFQ

SEQ ID NO: 3216 - protein, 170 aa, Homo sapiens
METHKELKPLLSPSSETTVTVELPEADRAGAGTGAQAGQLMGFFKGIDQDIERGVQSEIFLHESYCMDTSHQPLLPAPPKTPMDGADCGIQWWNAVFIMLLIGIVLPVFYLVYFKIQASGETPNSLNTTVIPNGSMAMGTVPGQAPRLAVAVPAVTSADSQFSQTTQAGS

SEQ ID NO: 3217 - protein, 420 aa, Homo sapiens [sequence omitted]

SEQ ID NO: 3218 - protein, 111 aa, Homo sapiens [sequence omitted]

SEQ ID NO: 3219 - protein, 119 aa, Homo sapiens
MCCNILVCCNIPVTFWCVVTFRCVVTFGVTRCVVTFWCVVTFWCVVTFWCVVTIAVCCNIRCVVTFQCVVTFGVTCCVVTFWCVVTFPVCCNVPGCVVTCRCGVPVCCNIPTFRCVGVL

SEQ ID NO: 3220 - protein, 182 aa, Homo sapiens
MGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTGGKRNAFGTYPEKAAAPAPFLPMTVL

SEQ ID NO: 3221 - protein, 104 aa, Homo sapiens [sequence omitted]

SEQ ID NO: 3222 - protein, 272 aa, Homo sapiens
MQIICKMASMLSKSTVERLLLPRFCELCGDRKLFQVRKVCAANFGDICHAVGQEATEKFLIPKFFELCSDAVWGMRKACAECFTAVSHSSSPGVRRTQLFPLFIRLVSDPCRWVHQAAFQSLGPFTSTFANPSRAGLYLREDGALSIWPLTQDLDSGFASGSPAPSSGGNTSPASLTRSAKPVRSEPELPVEGTSAKTSDCPHSSSSSDGPAESPVESCVSAGAEWTRVSPETSACSKLSDMNDLPISSYPGSDSWACPGNTEDVFSHFLYW

SEQ ID NO: 3223 - protein, 117 aa, Homo sapiens [sequence omitted]

SEQ ID NO: 3224 - protein, 307 aa, Homo sapiens [sequence omitted]

SEQ ID NO: 3225 - protein, 122 aa, Homo sapiens [sequence omitted]

SEQ ID NO: 3226 - protein, 127 aa, Homo sapiens
MKKKKIQKIYEFRVGFLKILIRKSASRLIQRMIEINTIRNDKGNVITTDPTEIETTIRNYCKHFCAYKLENFKEMDKFLDKYTLPQLSQEEIDLLNRPITSSEIESVINNLPIKKSPEHDGFPAIFY

SEQ ID NO: 3227 - protein, 112 aa, Homo sapiens [sequence omitted]

SEQ ID NO: 3228 - protein, 484 aa, Homo sapiens [sequence omitted]

SEQ ID NO: 3229 - protein, 380 aa, Homo sapiens
MSGAGVAAGTRPPSSPTPGSRRRRQRPSVGVQSLRPQSPQLRQSDPQKRNLDLEKSLQFLQQQHSEMLAKLHEEIEHLKRENKDLRYKLIMNQTSQKKDGPSGNHLSRASAPLGARWVCINGVWVEPGGPSPARLKEGSSRTHRPGGKHGRLAGGSADTVRSPADSLSTSSFQSVKSISNSGKARPQPGSFNKQDSKADVPQKADLEEEPLLHNSKLDKVPGVQGQARKEKAEASNAGAACMGNSQHQGRQMGAAAHPPMILPLPLRKPTTLRQCEVLIRELWNTNLLQTQELQHLKSLLEGSQRPQAVPEEASFPRDQEATHFPKVSTKSLSKKCLLLSPPVAERAILPALKQTPKNNFAERQKRLQAMQKRRLHRSVL

SEQ ID NO: 3230 - protein, 172 aa, Homo sapiens
MRDCCGMVSSGSLSSLKAAERTPGALFFSSSTPGRYYNYDSSSRPQSRSVMSDQCAGQWFLKACGLGEGDTEVFPTQHVVRALQTIFELNVQAFAGGAMGAVNGMQPHGVPDKSSVQSDEVWVGVVYGLAATMIQEVMHSFSHLSTICILAQKTSSTTKFLQGITQCHLVRL

SEQ ID NO: 3231 - protein, 105 aa, Homo sapiens
MHCSGAMKVLGSKGEKNGSLCGMIFLTKVIFGHHHIHGLMDDSQNDTYYFSFHPKSVIEIYTVCVCTGLFGHECHGSFPTLQGSLILWFRTEGKAYSQGELKHVG

SEQ ID NO: 3232 - protein, 313 aa, Homo sapiens
MGAEASSSWCPGTALPEERLSVKRASEISGFLGQGSSGEAALDVLTHVLEGAGNKLTSSCGKPSSNRMSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADLQKLKDELASTKQKLEKAENQVLAMRKQSEGLTKEYDRLLEEHAKLQAAVDGPMDKKEE

SEQ ID NO: 3233 - protein, 530 aa, Homo sapiens [sequence omitted]

SEQ ID NO: 3234 - protein, 159 aa, Homo sapiens
MSPAFRTMDVEPRTKGILLEPFVHQVGGHSCVLRFNETTLCKPLVPREHQFYETLPAEMRRFTPQYKGEPPAARGVSRLVRCKGFCQWKALAASWEPSPLPFTLLFSSSSSSWPSAQHLTLSFQALVRLLNCFVFWICFEFVFGRSIVIFLCSGVSCSR

SEQ ID NO: 3235 - protein, 125 aa, Homo sapiens
MDLGAFFLSPSSVFFFKRIFSLIRFREARQGRQGSSDVQSAGPEVVHQGSGKAARTWTFTVTSTFSSSGWHMPPQSDLKSLPPGPLFLPRRTPGTVILAASCLRGEPCVPFTSPSTSQALGQQRT

SEQ ID NO: 3236 - protein, 529 aa, Homo sapiens [sequence omitted]

SEQ ID NO: 3237 - protein, 118 aa, Homo sapiens
MRPGFQQAPRSGRVGLCDSRLSPSHLCCPRARPISAGPGGGALGVGALVTSAPLLAIPRAPPGCTLAPTSPSPPSPSGPATRCGPWQGTAPPSTGDPCTPRSQPVTAGTTSRPHRDRG

SEQ ID NO: 3238 - protein, 150 aa, Homo sapiens
MSTAALITLVRSGGNQVRRRVLLSSRLLQDDRRVTPTCHSSTSEPRCSRFDPDGSGSPATWDNFGIWDNRIDEPILLPPSIKYGKPIPKISLENVGCASQIGKRKENEDRFDFAQLTDEVLYFAVYDGHGGPAAADFCHTHMEKCIMYVQ

SEQ ID NO: 3239 - protein, 112 aa, Homo sapiens
MCGDCVEKEYPNRGNTCLENGSFLLNFTGCAVCSKRDFMLITNKSLKEEDGEEIVTYDHLCKNCHHVIARHEYTFSIMDEFQEYTMLCLLCGKAEDTISILPDDPRQMTLLF

SEQ ID NO: 3240 - protein, 243 aa, Homo sapiens
MEHSSNRPEDFPLNVFSVTPYTPSTADIQVSDDDKAGATLLFSGIFLGLVGITFTVMGWIKYQGVSHFEWTQLLGPILPSVGVTFILIAVCKFKMLSCQLCSDNEERVPDSDQTSGGQSFVFTGINQPITFHGATVVQYIPPPYGSQEPLGMNATYLQPMMNPCGLIPPSGAAAAAPSPPQYYTIYPQDNAAFVESEGFSPFVGTGYDRPDSDADQLEGTELEEEDCVCFSPPPYEEIYALPR

SEQ ID NO: 3241 - protein, 276 aa, Homo sapiens
MYRISQLMSTPVASSSRLEREYAGELSPTCIFPSFTCDSLDGYHSFECGSIDPLTGSHYTCRRSPRLLTNGYYIWTEDSFLCDKDGNITLNPSQTSVMYKENLVSTSKSWLHGSIFGDINSSPSEDNWLKGTRRLDTDHCNGNADDLDCSSLTDDWESGKMNAESVITSSSSHIISQPPGGNSHSLSLQSQLTASERFQENSSDHSETRLLQEVFFQAILLAVCLITSACARWFMGEILASVFTCSLMITVAYVKSLFLSLASYFKTTACARFVKI

SEQ ID NO: 3242 - protein, 104 aa, Homo sapiens [sequence omitted]

SEQ ID NO: 3243 - protein, 424 aa, Homo sapiens
MASMPPTPEAQGPILFEDLAVYFSQEECVTLHPAQRSLSKDGTKESLEDAALMGEEGKPEINQQLSLESMELDELALEKYPIAAPLVPYPEKSSEDGVGNPEAKILSGTPTYKRRVISLLVTIENHTPLVELSEYLGTNTLSEILDSPWEGAKNVYKCPECDQNFSDHSYLVLHQKIHSGEKKHKCGDCGKIFNHRANLRTHRRIHTGEKPYKCAKCSASFRQHSHLSRHMNSHVKEKPYTCSICGRGFMWLPGLAQHQKSHSAENTYESTNCDKHFNEKPNLALPEETFVSGPQYQHTKCMKSFRQSLYPALSEKSHDEDSERCSDDGDNFFSFSKFKPLQCPDCDMTFPCFSELISHQNIHTEERPHKCKTCEESFALDSELACHQKSHMLAEPFKCTVCGKTFKSNLHLITHKRTHIKNTT

SEQ ID NO: 3244 - protein, 520 aa, Homo sapiens
MGSRNSSSAGSGSGDPSEGLPRRGAGLRRSEEEEEEDEDVDLAQALLDSEEENDRAWDGRLGDRYNPPVDATPDTRELEFNEIKTQVELATGQLGLRRAAQKHSFPRMLHQRERGLCHRGSFSLGEQSRVISHFLPNDLGFTDSYSQKAFCGIYSKDGQIFMSACQDQTIRLYDCRYGRFRKFKSIKARDVGWSVLDVAFTPDGNHFLYSSWSDYIHICNIYGEGDTHTALDLRPDERRFAVFSIAVSSDGREVLGGANDGCLYVFDREQNRRTLQIESHEDDVNAVAFADISSQILFSGGDDAICKVWDRRTMREDDPKPVGALAGHQDGITFIDSKGDARYLISNSKDQTIKLWDIRRFSSREGMEASRQAATQQNWDYRWQQVPKKAWRKLKLPGDSSLMTYRGHGVLHTLIRCRFSPIHSTGQQFIYSGCSTGKVVVYDLLSGHIVKKLTNHKACVRDVSWHPFEEKIVSSSWDGNLRLWQYRQAEYFQDDMPESEECASAPAPVPQSSTPFSSPQ

SEQ ID NO: 3245 - protein, 375 aa, Homo sapiens
MNLWWKCRRPGLWVETAASSFVKTSPSMNYSRAPHTPFPEKMVSSCLDAQTGISHEDLIQNFLNAGSFPEIQGFLQLRGSGRGSGRKLWKRFFCFLRRSGLYYSTKGTSKDPRHLQYVADVNESNVYVVTQGRKLYGMPTDFGFCVKPNKLRNGHKGLHIFCSEDEQSRTCWLAAFRLFKYGVQLYKNYQQAQSRHLRLSYLGSPPLRSVSDNTLVAMDFSGHAGRVIDNPREALSAAMEEAQAWRKKTNHRLSLPTTCSGSSLSAAIHRTQPWFHGRISREESQRLIGQQGLVDGVFLVRESQRNPQGFVLSLCHLQKVKHYLILPSEDEGCLYFSMDEGQTRFTDLLQLVEFHQLNRGILPCLLRHCCARVAL

SEQ ID NO: 3246 - protein, 386 aa, Homo sapiens
MDLFIMIYILCLHFTRGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVLGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAA

SEQ ID NO: 3247 - protein, 564 aa, Homo sapiens
MDSHSGEPALLPCGTCDMVFRSSALLATHTQRFCIGHPTQVMTFGAQASVATEPQRAAVQWLRLSLQEMRPWITEVPRVFAGPWTRSEARPQSPMSEAVGSPSERLRALFRTRARRVAEMEAQSRALQLRGEELSRRLQVVACTRGGMSRLFGLEQEIRELQAEAGRTRGALEVLGARIQELQAEPGNPLSSRREAELYSPVQKANPGTLAAEIRALREAYIRDGGRDPGVLGQIWQLQVEASALELQRSQTRRGRAGATSGELPVVEAENRRLEAEILALQMQRGRAPLGPQDLRLLGDASLQPKGRRDPPLLPPPVAPPLPPLPGFSEPQLPGTMTRNLGLDSHFLLPTSDMLGPAPYDPGAGLVIFYDFLRGLEASWIWVQLRTGLARDGRDTGRTTALPPALCLPPPPAPGPMGNCAILASRQPVPRLPPSSSVSLVCELQVWQGLAWARAPQPKAWVSLGLFDQDQRVLSGRWRLPLRALPLDPSLSLGQLNGIPQAGQAELFLRLVNARDAAVQTLAEINPASVHEYQYPPPVRAQLQLGTPQLHIPVWLVWLTASLY

SEQ ID NO: 3248 - protein, 938 aa, Homo sapiens
MAEPGHSHHLSARVRGRTERRIPRLWRLLLWAGTAFQVTQGTGPELHACKESEYHYEYTACDSTGSRWRVAVPHTPGLCTSLPDPVKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITEKGSSSCNVRPACTDKDYFYTHTACDANGETQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSISVTNVMNGVASYCRPCALEASDVGSSCTSCPAGYYIDRDSGTCHSCPPNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCGLIRCLNFRSFFIEYPNPPFCLPQTCQIYPHFVCK

SEQ ID NO: 3249 - protein, 528 aa, Homo sapiens [sequence omitted]

SEQ ID NO: 3250 - protein, 501 aa, Homo sapiens [sequence omitted]

SEQ ID NO: 3251 - protein, 575 aa, Homo sapiens
MHHLWKIPRLFTLWGNEISCRTFHMNIKKLIPIQWGHQEAPAKFNFASDVIDHWASVEKAGKRSSGPALWWMNGSGKEIKWSFRELSEASKQTANVLSGACGLHRGDRVAVVLPRIPEWWLMILGCMRTGLVFMPGTIQMRSSDILYRLQASKARAIVAGDEVAQEVDAVAPDCSFLKIKLLVSENSREGWLNFKALLKEASTIHQCVETESRESAAIYFTSGTSGPPKMAEHSHCSLGIKAKMDAASWTGLSTSDIIWTISDTAWIMNILGAFLEPWVLGACIFVHLLPKFDSQTVLKVLSSYPINTLVGAPIIYRMLLQQDLSSYKFPHLHSCFSGGETLLPETLENWKAKTGLEIREIYGQTETGLICRVSRTMKVKPGYLGTAFAHYDVQVIDEQGNVLPPGKEGDIAIRVKPIWPIGMFSGYVDNPKKTQDNIRGDFWLMGDRGIKDPEGYFHFIGRSDDIINSSGYRIGPSEVENALMEHPAVSETAVISSPDPSRGEVVKAFVVLAPGFLSHDRDQLTKVLQEHVKSVTAPYKYPRKVEFVLDLPKTVTGKIERAKLRAKEWKTSGRA

SEQ ID NO: 3252 - protein, 144 aa, Homo sapiens [sequence omitted]

SEQ ID NO: 3253 - protein, 552 aa, Homo sapiens
MAFQELLNQVGSLGRFQILQISFVLFLVGLVVPHITMENFTAAIPNHRCWAPILDNDTASDNGSRILSQDDLLRISIPLDSNLRLDKCRRFAQPQWHLLHLNGTFSNETEPDTEPCVDGWVYDRSNFLSTIVTEWDLVCESQALNSVAKFSFMIGLFIGAIICGHLSDRFGRKFILTCALLQFAITETCVAFAPSFFIYCLLRFLAGMSVEPISVNSHLLMLEWTSPKFLGMVAVLTSCAASIGYMILAGLAFLFRIWRHLQLAMSVPIFFFLILTRWMSESARWLIVTNKPQKGLKELRKVAHMNGMKNSGNTLTMEVVEASMKNELEAAKRKSSPRDLFHTPILRKRICVLSFMRYLFTISIFGLSLHLQHLSTNIILLQFLSSALGILISVIGHFVLNHMGRRITQLVLMSLRGIFMLTAVFVPQEMQTLRIIMATLAAALSSLCMCVSNLHINELLPTTLRATGMGVIAMFGNSGLFLAPLFMLLATYSANLPWIFYGGFSILYGFSVFLLPETKNQPLPDSIHDVGNDWKESRQAKEEDSIIKVTRF

SEQ ID NO: 3254 - protein, 322 aa, Homo sapiens
MASALTDRTSRAPSTYTYTSRPRALPCQRSRYRDSLTQPDEEPMHYGNIMYDRRVIRGNTYALQTGPLLFDFDLEVKPVLEVLVGKTIEQSLLEVMEEEELANLRASQREYEELRNSERAEVQRLEEQERRHREEKERRKKQQWEIMHKHNETSQKIAARAFAQRYLADLLPSVFGSLRDSGYFYDPIERDIEIGFLPWLMNEVEKTMEYSMVGRTVLDMLIREVVEKRLCMYEHGEDTHQSPEPEDEPGGPGAMTESLEASEFLEQSMSQTRELLLDGGYLQRTTYDRRSSQERKFMEERELLGQDEETAMRKSLGEEELS

SEQ ID NO: 3255 - protein, 101 aa, Homo sapiens
MYKLQLPASFLLSRSLDDIPAFPPLSPLILAVFTLSPQHCLDSSSVSHPLFPWTTPQTCAHGLLLFLLFHLCPFCLIKDTVGSEQLRPFLFFCPMENNPSR

SEQ ID NO: 3256 - protein, 481 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYADQVAILEAAFLPLQEDTQELGWEETVDAAISHLLKTCLSKSSKEQALNLNSQLNIPKDTSQLKKHITLLCDRLSKGGRLCLSTDAAAPQTMVMPGKSSVHAP

SEQ ID NO: 3257 - protein, 418 aa, Homo sapiens
MFSKCMLTAFEIIITIKSVTQVLSSDVPSGTETEEEDDGMNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIRIPALLPPTSTELDVPHNVQVAAVVGIGLVYQGTAHRHTAEVLLAEIGRPPGPEMEYCTDRKSYSLAAGLALGMVCLGHGSNLIGMSDLNVPEQLYQYMVGGHRRFQTGMHREKHKSPSYQIKEGDTINVDVTCPGATLALAMIYLKTNNRYFYPLTLPPTVIV

SEQ ID NO: 3258 - protein, 103 aa, Homo sapiens
MEAASVWKIFLLLCSPLTFYYCVLSLANSYSSLKAHSTVTSENPSWALPGRIPLSFMLSQNLEYSSIIALTAVITCCLFTHLWMLSLLMFLPPAPAQWSGAQR

SEQ ID NO: 3259 - protein, 231 aa, Homo sapiens
MSFNLQSSKKLFIFLGKSLFSLLEAMIFALLPKPRKNVAGEIVLITGAGSGLGRLLALQFARLGSVLVLWDINKEGNEETCKMAREAGATRVHAYTCDCSQKEGVYRVADQVKKEVGDVSILINNAGIVTGKKFLDCPDELMEKSFDVNFKAHLWTYKAFLPAMIANDHGHLVCISSSAGLSGVNGLADYCASKFAAFGFAESVFVETFVQKQKGIKTTIVCPFFYKNWNV

SEQ ID NO: 3260 - protein, 118 aa, Homo sapiens
MKKMTKNIIDMWKWLFDYNNCIMTSDFILQPTVISQLPLQCERCYQRFCIPYGLKLLRRNIFLCLTKAYEENVTKIFIKGQVRWLTPVIPALWEAKAGRSRGQEFKTSLANIGKPHLY

SEQ ID NO: 3261 - protein, 501 aa, Homo sapiens
MDTEKSRFFRFCVAIKKENYPDYMPSNIFSDSAKQIFRQPGHTIYLLPTVVICNLLPCELDFYVKGMPINGTLKPGKEAALHTADTSQNIELGVSLENFPLCKELLIPPGTQNYMVRMRLYDVNRRQLNLTIRIVCRAEGSLKIFISAPYWLINKTGLPLIFRQDNAKTDAAGQFEEHELARSLSPLLFCYADKEQPNLCTMRIGRGIHPEGMPGWCQGFSLDGGSGVRALKVIQQGNRPGLIYNIGIDVKKGRGRYIDTCMVIFAPRYLLDNKSSHKLAFAQREFARGQGTANPEGYISTLPGSSVVFHWPRNDYDQLLCVRLMDVPNCIWSGGFEVNKNNSFHINMRDTLGKCFFLRVEITLRGATYRISFSDTDQLPPPFRIDNFSKVPVVFTQHGVAEPRLRTEVKPMTSLDYAWDEPTLPPFITLTVKGAGSSEINCNMNDFQDNRQLYYENFIYIAATYTFSGLQEGTGRPVASNKAITCAELVLDVSPKTQRVI

SEQ ID NO: 3262 - protein, 190 aa, Homo sapiens
MEAETKTLPLENASILSEGSLQEGHRLWIGNLDPKITEYHLLKLLQKFGKVKQFDFLFHKSGALEGQPRGYCFVNFETKQEAEQAIQCLNGKLALSKKLVVRWAHAQVKRYDHNKNDKILPISLEPSSSTEPTQSNLSVTAKIKAIEAKLKMMAENPDAEYPAAPVYSYFKPPDKKRTTPYSRTAWKSRR

SEQ ID NO: 3263 - protein, 301 aa, Homo sapiens
MAQQHSSHTGAPVQQAASPTNPTAISPEEYFDPNFSLESRNIGRPIEMSSKVQRFKATLWLSEEHPLSLGDQVTPIIDLMAISNAHFAKLRDFITLRLPPGFPVKIEIPLFHVLNARITFSNLCGCDEPLSSVWVPAPSSAVAASGNPFPCEVDPTVFEVPNGYSVLGMERNEPLRDEDDDLLQFAIQQSLLEAGTEAEQVTVWEALTNTRPGARPPPQATVYEEQLQLERALQESLQLSTEPRGPGSPPRTPPAPGPPSFEEQLRLALELSSREQEERERRGQQEEEDLQRILQLSLTEH

SEQ ID NO: 3264 - protein, 107 aa, Homo sapiens
MPGSRDTVHSRQEEGYSRQKGGLCKSTEMQDRCLWRYQRAFISFITRILVSPGPLITTACLSLESARCPSCPPPPPWTTPSLQRLPDWLSFLLPCPVSSLCSLHSSE

SEQ ID NO: 3265 - protein, 102 aa, Homo sapiens [sequence omitted]

SEQ ID NO: 3266 - protein, 230 aa, Homo sapiens
MAQGLIEVERKFLPGPGTEERLQELGGTLEYRVTFRDTYYDTPELSLMQADHWLRRREDSGWELKCPGAAGVLGPHTEYKELTAEPTIVAQLCKVLRADGLGAGDVAAVLGPLGLQEVASFVTKRSAWKLVLLGADEEEPQLRVDLDTADFGYAVGEVEALVHEEAEVPTALEKIHRLSSMLGVPAQETAPAKLIVYLQRFRPQDYQRLLEVNSSRERPQETEDPDHCLG

SEQ ID NO: 3267 - protein, 213 aa, Homo sapiens
MDPLQKRNPASPSKSSPMTAAETSQEGPAPSQPSYSEQPMMGLSNLSPGPGPSQAVPLPEGLLRQRYREEKTLEERRWERLEFLQRKKAFLRHVRRRHRDHMAPYAVGREARISPLGDRSQNRFRCECRYCQSHRPNLSGIPGESNRAPHPSSWETLVQGLSGLTLSLGTNQPGPLPEAALQPQETEEKRQRERQQESKIMFQRLLKQWLEEN

SEQ ID NO: 3268 - protein, 692 aa, Homo sapiens
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKKYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 3269 - protein, 114 aa, Homo sapiens [sequence omitted]

SEQ ID NO: 3270 - protein, 213 aa, Homo sapiens
MRVRGPARLIASGARLLLRMLSALPGWGPAHLQRPLLGPASCLGILRPAMTAHSFALPVIIFTTFWGLVGIAGPWFVPKGPNRGVIITMLVATAVCCYLLCPALGMTVAPLSLTTPSSGPSPTQLCLVTSSLLLAPRDPDPQGLPGSWKSSQSSQPARALGSPGHSSGRGDVLLQYPHCSGVCPLSQGDAAGELVWVGSFPLQTGQMPGLSPS

SEQ ID NO: 3271 - protein, 406 aa, Homo sapiens [sequence omitted]

SEQ ID NO: 3272 - protein, 120 aa, Homo sapiens [sequence omitted]

SEQ ID NO: 3273 - protein, 169 aa, Homo sapiens
MHYDTPDIRRFDPIPAQYVRVYPERWSPAGIGMRLEVLGCDWTGKMTFPPLCISPTWSSDPGIPRGPGRAVEGAAIPGAGNAADPCHVLLPQTTGTAASGLGTVSQGMYFVFFKGSFQFSNPSLSKTNHNHTPPTQIQLDPGSSGQRAVAVDLGKKKTPHDNKVIGLCL

SEQ ID NO: 3274 - protein, 228 aa, Homo sapiens
MTDQTYCDRLVQDTPFLTGHGRLSEQQVDRIILQLNRYYPQILTNKEAEKFRNPKASLRVRLCDLLSHLQRSGERDCQEFYRALYIHAQPLHSRLPSRHALRKFHITNHACLVLARGGHPSLPLMAWMSSMTTQVCCSPGLASPLASAPPQRPPSGPEGRVWQAQAVQMLVSVSHFLPLPPSLSHGSFHTAWGILYVHSCPSFSNLIPRGSLHVCVDSNLVPTAAWRS

SEQ ID NO: 3275 - protein, 195 aa, Homo sapiens
MGLSALPSWSWAGSGGSILAWMGWQRGRCPHPSPLPLPPVSGLFCLVWAWAWGELMERLEGASCRERPQGRQGQHPPSKGLCLTQETPSSQQGQPITVGMEWSREWGQRPRLPPHRAVPGKGSPSAKCSSGPCSRLLWLWEALLLPLLGRFLWGPPCHVLCAQAVSQGCPLCPTVTSATRTNPRDLEGAHQTGQG

SEQ ID NO: 3276 - protein, 115 aa, Homo sapiens [sequence omitted]

SEQ ID NO: 3277 - protein, 122 aa, Homo sapiens [sequence omitted]

SEQ ID NO: 3278 - protein, 560 aa, Homo sapiens
MNRKWEAKLKQIEERASHYERKPLSSVYRPRLSKPEEPPSIWRLFHRQAQAFNFVKSCKEDVHVFALECKVGDGQRIYLVTTYAEFWFYYKSRKNLLHCYEVIPENAVCKLYFDLEFNKPANPGADGKKMVALLIEYVCKALQELYGVNCSAEDVLNLDSSTDEKFSRHLIFQLHDVAFKDNIHVGNFLRKILQPALDLLGSEDDDSAPETTGHGFPHFSEAPARQGFSFNKMFTEKATEESWTSNSKKLERLGSAEQSSPDLSFLVVKNNMGEKHLFVDLGVYTRNRNFRLYKSSKIGKRVALEVTEDNKFFPIQSKDVSDEYQYFLSSLVSNVRFSDTLRILTCEPSQNKQKGVGYFNSIGTSVETIEGFQCSPYPEVDHFVLSLVNKDGIKGGIRRWNYFFPEELLVYDICKYRWCENIGRAHKSNNIMILVDLKNEVWYQKCHDPVCKAENFKSDCFPLPAEVCLLFLFKEEEEFTTDEADETRSNETQNPHKPSPSRLSTGASADAVWDNGIDDAYFLEATEDAELAEAAENSLLSYNSEVDEIPDELIIEVLQE

SEQ ID NO: 3279 - RNA, 30 nt, Artificial Sequence
  Description of Artificial Sequence: an artificially synthesized oligo-cap linker sequence
agcaucgagucggccuuguuggccuacugg

SEQ ID NO: 3280 - DNA, 42 bp, Artificial Sequence
  Description of Artificial Sequence: an artificially synthesized oligo(dT) primer sequence
gcggctgaagacggcctatgtggccttttttttttttttttt

SEQ ID NO: 3281 - DNA, 21 bp, Artificial Sequence
  Description of Artificial Sequence: an artificially synthesized primer sequence
agcatcgagtcggccttgttg

SEQ ID NO: 3282 - DNA, 21 bp, Artificial Sequence
  Description of Artificial Sequence: an artificially synthesized primer sequence
gcggctgaagacggcctatgt

SEQ ID NO: 3283 - DNA, 23 bp, Artificial Sequence
  Description of Artificial Sequence: an artificially synthesized adaptor sequence
gtacatattgtcgttagaacgcg

SEQ ID NO: 3284 - DNA, 27 bp, Artificial Sequence
  Description of Artificial Sequence: an artificially synthesized adaptor sequence
gatccgcgttctaacgacaatatgtac

SEQ ID NO: 3285 - DNA, 26 bp, Artificial Sequence
  Description of Artificial Sequence: an artificially synthesized adaptor sequence
gtacatattgtcgttagaacgcgact

SEQ ID NO: 3286 - DNA, 30 bp, Artificial Sequence
  Description of Artificial Sequence: an artificially synthesized adaptor sequence
gatcagtcgcgttctaacgacaatatgtac

SEQ ID NO: 3287 - DNA, 29 bp, Artificial Sequence
  Description of Artificial Sequence: an artificially synthesized adaptor sequence
gtacatattgtcgttagaacgcgcatact

SEQ ID NO: 3288 - DNA, 33 bp, Artificial Sequence
  Description of Artificial Sequence: an artificially synthesized adaptor sequence
gatcagtatgcgcgttctaacgacaatatgtac

SEQ ID NO: 3289 - DNA, 32 bp, Artificial Sequence
  Description of Artificial Sequence: an artificially synthesized adaptor sequence
gtacatattgtcgttagaacgcgatccatact

SEQ ID NO: 3290 - DNA, 36 bp, Artificial Sequence
  Description of Artificial Sequence: an artificially synthesized adaptor sequence
gatcagtatggatcgcgttctaacgacaatatgtac

SEQ ID NO: 3291 - DNA, 35 bp, Artificial Sequence
  Description of Artificial Sequence: an artificially synthesized adaptor sequence
gtacatattgtcgttagaacgcgtcaatccatact

SEQ ID NO: 3292 - DNA, 39 bp, Artificial Sequence
  Description of Artificial Sequence: an artificially synthesized adaptor sequence
gatcagtatggattgacgcgttctaacgacaatatgtac

SEQ ID NO: 3293 - DNA, 38 bp, Artificial Sequence
  Description of Artificial Sequence: an artificially synthesized adaptor sequence
gtacatattgtcgttagaacgcgtactcaatccatact

SEQ ID NO: 3294 - DNA, 42 bp, Artificial Sequence
  Description of Artificial Sequence: an artificially synthesized adaptor sequence
gatcagtatggattgagtacgcgttctaacgacaatatgtac

SEQ ID NO: 3295 - DNA, 22 bp, Artificial Sequence
  Description of Artificial Sequence: an artificially synthesized primer sequence
gtacatattgtcgttagaacgc

SEQ ID NO: 3296 - DNA, 18 bp, Artificial Sequence
  Description of Artificial Sequence: an artificially synthesized primer sequence
ctcctccagcagaacttg

SEQ ID NO: 3297 - DNA, 20 bp, Artificial Sequence
  Description of Artificial Sequence: an artificially synthesized primer sequence
tttagagctgattccccatt

SEQ ID NO: 3298 - DNA, 20 bp, Artificial Sequence
  Description of Artificial Sequence: an artificially synthesized primer sequence
taaaagcaggaaattgtaaa

SEQ ID NO: 3299 - DNA, 20 bp, Artificial Sequence
  Description of Artificial Sequence: an artificially synthesized primer sequence
atatggacaaaggaccaatt

SEQ ID NO: 3300 - DNA, 20 bp, Artificial Sequence
  Description of Artificial Sequence: an artificially synthesized primer sequence
aggactagattcactgctta

SEQ ID NO: 3301 - DNA, 20 bp, Artificial Sequence
  Description of Artificial Sequence: an artificially synthesized primer sequence
caactctcaacaccacaatc

SEQ ID NO: 3302 - DNA, 20 bp, Artificial Sequence
  Description of Artificial Sequence: an artificially synthesized primer sequence
ctactcaaggacagccacac

SEQ ID NO: 3303 - DNA, 20 bp, Artificial Sequence
  Description of Artificial Sequence: an artificially synthesized primer sequence
agatagaggcttgctggtgt

SEQ ID NO: 3304 - DNA, 20 bp, Artificial Sequence
  Description of Artificial Sequence: an artificially synthesized primer sequence
ccttatgtcaaactgcgatt

SEQ ID NO: 3305 - DNA, 20 bp, Artificial Sequence
  Description of Artificial Sequence: an artificially synthesized primer sequence
tttgccttattcattggttg

SEQ ID NO: 3306 - DNA, 20 bp, Artificial Sequence
  Description of Artificial Sequence: an artificially synthesized primer sequence
gtaatatcaccccacagagg

SEQ ID NO: 3307 - DNA, 20 bp, Artificial Sequence
  Description of Artificial Sequence: an artificially synthesized primer sequence
tatcatcttttggggctttg

SEQ ID NO: 3308 - DNA, 20 bp, Artificial Sequence
  Description of Artificial Sequence: an artificially synthesized primer sequence
aataagccagttgcatcctc

SEQ ID NO: 3309 - DNA, 20 bp, Artificial Sequence
  Description of Artificial Sequence: an artificially synthesized primer sequence
tctctcatctccaaacatgc

SEQ ID NO: 3310 - DNA, 20 bp, Artificial Sequence
  Description of Artificial Sequence: an artificially synthesized primer sequence
tgaattgaaagagacacact

SEQ ID NO: 3311 - DNA, 20 bp, Artificial Sequence
  Description of Artificial Sequence: an artificially synthesized primer sequence
cttaatccagttcatcagct

SEQ ID NO: 3312 - DNA, 20 bp, Artificial Sequence
  Description of Artificial Sequence: an artificially synthesized primer sequence
ttttgagacagagtttcgct

SEQ ID NO: 3313 - DNA, 20 bp, Artificial Sequence
  Description of Artificial Sequence: an artificially synthesized primer sequence
atgttttacgattgcctttg

SEQ ID NO: 3314 - DNA, 20 bp, Artificial Sequence
  Description of Artificial Sequence: an artificially synthesized primer sequence
gaagcatctttggtgtacta

SEQ ID NO: 3315 - DNA, 20 bp, Artificial Sequence
  Description of Artificial Sequence: an artificially synthesized primer sequence
tgtccctggaaagtaatata

SEQ ID NO: 3316 - DNA, 20 bp, Artificial Sequence
  Description of Artificial Sequence: an artificially synthesized primer sequence
aacacagtagccagaaccag

SEQ ID NO: 3317 - DNA, 20 bp, Artificial Sequence
  Description of Artificial Sequence: an artificially synthesized primer sequence
aagagcctactacacgccag

SEQ ID NO: 3318 - DNA, 20 bp, Artificial Sequence
  Description of Artificial Sequence: an artificially synthesized primer sequence
tttaagagcacacagaagtc

SEQ ID NO: 3319 - DNA, 20 bp, Artificial Sequence
  Description of Artificial Sequence: an artificially synthesized primer sequence
attactggtgtggagtgggt

SEQ ID NO: 3320 - DNA, 20 bp, Artificial Sequence
  Description of Artificial Sequence: an artificially synthesized primer sequence
actctgccttcactttcctt

SEQ ID NO: 3321 - DNA, 20 bp, Artificial Sequence
  Description of Artificial Sequence: an artificially synthesized primer sequence
gataaaggatacagccaaaa

SEQ ID NO: 3322 - DNA, 20 bp, Artificial Sequence
  Description of Artificial Sequence: an artificially synthesized primer sequence
atcatggtcgttacagaatt

SEQ ID NO: 3323 - DNA, 20 bp, Artificial Sequence
  Description of Artificial Sequence: an artificially synthesized primer sequence
actgccttcaatctcaggtt

SEQ ID NO: 3324 - DNA, 20 bp, Artificial Sequence
  Description of Artificial Sequence: an artificially synthesized primer sequence
atcactgccaatttcacaaa

SEQ ID NO: 3325 - DNA, 16 bp, Artificial Sequence
  Description of Artificial Sequence: an artificially synthesized primer sequence
ccaccgagttctgttg

SEQ ID NO: 3326 - DNA, 20 bp, Artificial Sequence
  Description of Artificial Sequence: an artificially synthesized primer sequence
gtcatggccacagttgtatc

SEQ ID NO: 3327 - DNA, 20 bp, Artificial Sequence
  Description of Artificial Sequence: an artificially synthesized primer sequence
gataaaggatacagccaaaa

SEQ ID NO: 3328 - DNA, 20 bp, Artificial Sequence
  Description of Artificial Sequence: an artificially synthesized primer sequence
cccaaaatgtgtattattca

SEQ ID NO: 3329 - DNA, 20 bp, Artificial Sequence
  Description of Artificial Sequence: an artificially synthesized primer sequence
ttcggcaataatcttctctt

SEQ ID NO: 3330 - DNA, 20 bp, Artificial Sequence
  Description of Artificial Sequence: an artificially synthesized primer sequence
ccaccaacacttagacatca

SEQ ID NO: 3331 - DNA, 20 bp, Artificial Sequence
  Description of Artificial Sequence: an artificially synthesized primer sequence
gaattataggtgcacaacac

SEQ ID NO: 3332 - DNA, 21 bp, Artificial Sequence
  Description of Artificial Sequence: an artificially synthesized primer sequence
tcttctagtggaagaggttta

SEQ ID NO: 3333 - DNA, 20 bp, Artificial Sequence
  Description of Artificial Sequence: an artificially synthesized primer sequence
tatctgaaaatgtgtttggt

SEQ ID NO: 3334 - DNA, 20 bp, Artificial Sequence
  Description of Artificial Sequence: an artificially synthesized primer sequence
actcctggctttctatttcc

SEQ ID NO: 3335 - DNA, 20 bp, Artificial Sequence
  Description of Artificial Sequence: an artificially synthesized primer sequence
gacagtctcgctgtatctcc

SEQ ID NO: 3336 - DNA, 20 bp, Artificial Sequence
  Description of Artificial Sequence: an artificially synthesized primer sequence
acatccagtacaccttctcc

SEQ ID NO: 3337 - DNA, 20 bp, Artificial Sequence
  Description of Artificial Sequence: an artificially synthesized primer sequence
gtcgaaagtgttgctcctag

SEQ ID NO: 3338 - DNA, 20 bp, Artificial Sequence
  Description of Artificial Sequence: an artificially synthesized primer sequence
tcatagctgaggggttaagt

SEQ ID NO: 3339 - DNA, 20 bp, Artificial Sequence
  Description of Artificial Sequence: an artificially synthesized primer sequence
atagctcttgtttcagtgtg

SEQ ID NO: 3340 - DNA, 20 bp, Artificial Sequence
  Description of Artificial Sequence: an artificially synthesized primer sequence
aagcatgtgggagttattta

SEQ ID NO: 3341 - DNA, 20 bp, Artificial Sequence
  Description of Artificial Sequence: an artificially synthesized primer sequence
cttgagagtccaggtttcct

SEQ ID NO: 3342 - DNA, 20 bp, Artificial Sequence
  Description of Artificial Sequence: an artificially synthesized primer sequence
cccataaagaatagaagctc

SEQ ID NO: 3343 - DNA, 20 bp, Artificial Sequence
  Description of Artificial Sequence: an artificially synthesized primer sequence
ctcatggggctaagtctatt

SEQ ID NO: 3344 - DNA, 20 bp, Artificial Sequence
  Description of Artificial Sequence: an artificially synthesized primer sequence
tcaaagtccaggatagcatt

SEQ ID NO: 3345 - DNA, 20 bp, Artificial Sequence
  Description of Artificial Sequence: an artificially synthesized primer sequence
actgatttggttctgcgatt

SEQ ID NO: 3346 - DNA, 20 bp, Artificial Sequence
  Description of Artificial Sequence: an artificially synthesized primer sequence
cttacttcgagttctagcac

SEQ ID NO: 3347 - DNA, 20 bp, Artificial Sequence
  Description of Artificial Sequence: an artificially synthesized primer sequence
tgctgctcatgttaaacttg

SEQ ID NO: 3348 - DNA, 20 bp, Artificial Sequence
  Description of Artificial Sequence: an artificially synthesized primer sequence
aaacatcatctcttccttgg

SEQ ID NO: 3349 - DNA, 20 bp, Artificial Sequence
  Description of Artificial Sequence: an artificially synthesized primer sequence
gctgaagagaacaataagtc

SEQ ID NO: 3350 - DNA, 20 bp, Artificial Sequence
  Description of Artificial Sequence: an artificially synthesized primer sequence
gacagagtagtggggcatct

SEQ ID NO: 3351 - DNA, 20 bp, Artificial Sequence
  Description of Artificial Sequence: an artificially synthesized primer sequence
ttcagcaggtagacaacatc

SEQ ID NO: 3352 - DNA, 20 bp, Artificial Sequence
  Description of Artificial Sequence: an artificially synthesized primer sequence
cctctctttcagttgagcat

SEQ ID NO: 3353 - DNA, 15 bp, Artificial Sequence
  Description of Artificial Sequence: an artificially synthesized primer sequence
gggcttgttttacgc

SEQ ID NO: 3354 - DNA, 20 bp, Artificial Sequence
  Description of Artificial Sequence: an artificially synthesized primer sequence
cctaggcagtaacatgaaaa

SEQ ID NO: 3355 - DNA, 20 bp, Artificial Sequence
  Description of Artificial Sequence: an artificially synthesized primer sequence
gcagacaggtacagctgagt

SEQ ID NO: 3356 - DNA, 20 bp, Artificial Sequence
  Description of Artificial Sequence: an artificially synthesized primer sequence
ttattttagttaccttggca

SEQ ID NO: 3357 - DNA, 20 bp, Artificial Sequence
  Description of Artificial Sequence: an artificially synthesized primer sequence
actgtaaatctccttgcctt

SEQ ID NO: 3358 - DNA, 20 bp, Artificial Sequence
  Description of Artificial Sequence: an artificially synthesized primer sequence
gagtttggggacagtcaagt

SEQ ID NO: 3359 - DNA, 20 bp, Artificial Sequence
  Description of Artificial Sequence: an artificially synthesized primer sequence
aaatgcaaaattgctgagat

SEQ ID NO: 3360 - DNA, 20 bp, Artificial Sequence
  Description of Artificial Sequence: an artificially synthesized primer sequence
ttcagcaggtagacaacatc

SEQ ID NO: 3361 - DNA, 20 bp, Artificial Sequence
  Description of Artificial Sequence: an artificially synthesized primer sequence
gtcgctgaaatttgcttctt

SEQ ID NO: 3362 - DNA, 20 bp, Artificial Sequence
  Description of Artificial Sequence: an artificially synthesized primer sequence
ccatatccactttcatcatc

SEQ ID NO: 3363 - DNA, 20 bp, Artificial Sequence
  Description of Artificial Sequence: an artificially synthesized primer sequence
caagaaactgacaatcacgg

SEQ ID NO: 3364 - DNA, 20 bp, Artificial Sequence
  Description of Artificial Sequence: an artificially synthesized primer sequence
aaggagttgacattttgctg

SEQ ID NO: 3365 - DNA, 20 bp, Artificial Sequence
  Description of Artificial Sequence: an artificially synthesized primer sequence
ttttcagagggctttgtgtt

SEQ ID NO: 3366 - DNA, 20 bp, Artificial Sequence
  Description of Artificial Sequence: an artificially synthesized primer sequence
ataactgaacccatggaaag

SEQ ID NO: 3367 - DNA, 20 bp, Artificial Sequence
  Description of Artificial Sequence: an artificially synthesized primer sequence
acatccagtacaccttctcc

SEQ ID NO: 3368 - DNA, 20 bp, Artificial Sequence
  Description of Artificial Sequence: an artificially synthesized primer sequence
gcactaggagactgtcaaaa

SEQ ID NO: 3369 - DNA, 20 bp, Artificial Sequence
  Description of Artificial Sequence: an artificially synthesized primer sequence
ggtatcttggagctcctcag

SEQ ID NO: 3370 - DNA, 20 bp, Artificial Sequence
  Description of Artificial Sequence: an artificially synthesized primer sequence
gtcagcatctactctgggtc

SEQ ID NO: 3371 - DNA, 20 bp, Artificial Sequence
  Description of Artificial Sequence: an artificially synthesized primer sequence
aagaaataaacacacgaaaa

SEQ ID NO: 3372 - DNA, 20 bp, Artificial Sequence
  Description of Artificial Sequence: an artificially synthesized primer sequence
aaatgcaaaattgctgagat

SEQ ID NO: 3373 - DNA, 20 bp, Artificial Sequence
  Description of Artificial Sequence: an artificially synthesized primer sequence
cagaacactcctcatacctc

SEQ ID NO: 3374 - DNA, 20 bp, Artificial Sequence
  Description of Artificial Sequence: an artificially synthesized primer sequence
aaagtacagcagaagatggg

SEQ ID NO: 3375 - DNA, 20 bp, Artificial Sequence
  Description of Artificial Sequence: an artificially synthesized primer sequence
aacagcttcttcatcacagt

SEQ ID NO: 3376 - DNA, 20 bp, Artificial Sequence
  Description of Artificial Sequence: an artificially synthesized primer sequence
atagaggaaggtggcaactg

SEQ ID NO: 3377 - DNA, 20 bp, Artificial Sequence
  Description of Artificial Sequence: an artificially synthesized primer sequence
ctcttttccatcacattccc

SEQ ID NO: 3378 - DNA, 20 bp, Artificial Sequence
  Description of Artificial Sequence: an artificially synthesized primer sequence
ccaagttctcattccacatt

SEQ ID NO: 3379 - DNA, 20 bp, Artificial Sequence
  Description of Artificial Sequence: an artificially synthesized primer sequence
agctaacaaggttttgacac

SEQ ID NO: 3380 - DNA, 20 bp, Artificial Sequence
  Description of Artificial Sequence: an artificially synthesized primer sequence
agactgggtcttgccatact

SEQ ID NO: 3381 - protein, 20 aa, Artificial Sequence
  Description of Artificial Sequence: Illustrative zinc finger peptide
  MOD_RES (2)..(9): Variable amino acid
  MOD_RES (11)..(15): Variable amino acid
  MOD_RES (17)..(19): Variable amino acid
CXXXXXXXXCXXXXXCXXXH
